(12) United States Patent
Melquist et al.

(10) Patent No.: US 9,932,586 B2
(45) Date of Patent: Apr. 3, 2018

(54) COMPOSITIONS AND METHODS FOR INHIBITING GENE EXPRESSION OF LPA

(71) Applicant: Arrowhead Pharmaceuticals, Inc., Pasadena, CA (US)

(72) Inventors: Stacey Melquist, Madison, WI (US); Steven Kanner, Madison, WI (US); David B. Rozema, Cross Plains, WI (US); David L. Lewis, Madison, WI (US); Lauren J. Almeida, Madison, WI (US); Darren H. Wakefield, Fitchburg, WI (US); Vladimir S. Trubetskoy, Middleton, WI (US); Tao Pei, Middleton, WI (US); Zhen Li, Monona, WI (US); Aaron Almeida, Madison, WI (US)

(73) Assignee: Arrowhead Pharmaceuticals, Inc., Pasadena, CA (US)

(*) Notice: Subject to any disclaimer, the term of this patent is extended or adjusted under 35 U.S.C. 154(b) by 0 days.

(21) Appl. No.: 15/281,309

(22) Filed: Sep. 30, 2016

(65) Prior Publication Data
US 2017/0096665 A1    Apr. 6, 2017

Related U.S. Application Data

(60) Provisional application No. 62/383,221, filed on Sep. 2, 2016, provisional application No. 62/346,304, filed on Jun. 6, 2016, provisional application No. 62/235,816, filed on Oct. 1, 2015.

(51) Int. Cl.
| | |
|---|---|
| *C12N 15/113* | (2010.01) |
| *A61K 31/7105* | (2006.01) |
| *A61K 31/7115* | (2006.01) |
| *A61K 31/712* | (2006.01) |
| *A61K 31/7125* | (2006.01) |
| *A61K 31/713* | (2006.01) |

(52) U.S. Cl.
CPC ........ *C12N 15/113* (2013.01); *C12N 15/1137* (2013.01); *C12Y 304/21* (2013.01); *C12N 2310/14* (2013.01); *C12N 2310/31* (2013.01); *C12N 2310/315* (2013.01); *C12N 2310/321* (2013.01); *C12N 2310/351* (2013.01); *C12N 2310/3517* (2013.01)

(58) Field of Classification Search
None
See application file for complete search history.

(56) References Cited

U.S. PATENT DOCUMENTS

| | | | |
|---|---|---|---|
| 5,877,022 A | 3/1999 | Stinchcomb et al. | |
| 5,885,968 A | 3/1999 | Biessen et al. | |
| 7,741,305 B2 | 6/2010 | Crooke et al. | |
| 8,084,599 B2 | 12/2011 | Rossi et al. | |
| 8,349,809 B2 | 1/2013 | Brown | |
| 8,513,207 B2 | 8/2013 | Brown | |
| 2004/0259248 A1* | 12/2004 | Tuschl | A61K 48/00 435/375 |

FOREIGN PATENT DOCUMENTS

| | | |
|---|---|---|
| WO | 2000053722 A2 | 9/2000 |
| WO | 2003/014307 A2 | 2/2003 |
| WO | 2005/000201 A2 | 1/2005 |
| WO | 2008022309 A2 | 2/2008 |
| WO | 2011104169 A1 | 9/2011 |
| WO | 2012083185 A2 | 6/2012 |
| WO | 2012092373 A2 | 7/2012 |
| WO | 2013032829 A2 | 3/2013 |
| WO | 2013158141 A1 | 10/2013 |
| WO | 2013/177468 A2 | 11/2013 |
| WO | 2014/179625 A1 | 11/2014 |
| WO | 2016196239 A1 | 12/2016 |

OTHER PUBLICATIONS

Iobst, S.T. and Drickamer, K. J.B.C.; "Selective Sugar Binding to the Carbohydrate Recognition Domains of the Rat Hepatic and Macrophage Asialoglycoprotein Receptors"; vol. 271, No. 12; pp. 6686-6693; 1996.
Baenziger and Fiete; "Galactose and N-Acetylgalactosamine-Specific Endocytosis of Glycopeptides by Isolated Rat Hepatocytes"; Cell, 22, 611-620; 1980.
Connolly et al.; "Binding and Endocytosis of Cluster Glycosides by Rabbit Hepatocytes"; J. Biol. Chem., 257, 939-945; 1982.
Biessen et al.; "Synthesis of Cluster Galactosides with High Affinity for the Hepatic Asialoglycoprotein Receptor"; J. Med. Chem.; vol. 39 p. 1538-1546; 1995.
GenBank Accession No. NM_005577.1 (1987).
Frazer KA et al.; "The apolipoprotein(a) gene is regulated by sex hormones and acute-phase inducers in YAC transgenic mice"; Nature Genetics 9:424-431; 1995.
Callow MJ et al.; "Expression of human apolipoprotein B and assembly of lipoprotein(a) in transgenic mice"; PNAS 91:2130-2134; 1994.
Tadin-Strapps, M. et al.; "Development of Lipoprotein(a) siRNAs for Mechanism of Action Studies in Non-Human Primate Models of Atherosclerosis"; J. of Cardiovasc. Trans. Res.; 8:44-53; 2015.
Integrated DNA Technologies, Inc. (2005), "Dicer substrate RNAi design".

(Continued)

*Primary Examiner* — Richard A Schnizer
(74) *Attorney, Agent, or Firm* — Amgen Inc.; Angela L. Purcell

(57) ABSTRACT

RNA interference (RNAi) agents and RNAi agent conjugates for inhibiting the expression of the LPA (apo(a)) gene are described. Pharmaceutical compositions comprising one or more LPA RNAi agents optionally with one or more additional therapeutics are also described. Delivery of the described LPA RNAi agents to liver cells in vivo provides for inhibition of LPA gene expression and treatment of cardiovascular and cardiovascular-related diseases.

39 Claims, 3 Drawing Sheets

(56) References Cited

OTHER PUBLICATIONS

Merki, Esther et al. (2011), "Antisense oligonucleotide lowers plasma levels of apolipoprotein (a) and lipoprotein (a) in transgenic mice", J. Am. Coll. Cardiol., 57(15):1611-1621.
NCBI Reference Sequence: NM_005577.2 (Mar. 15, 2015), *Homo sapiens* lipoprotein(a) (LPA), mRNA.
Search Report and Written Opinion for PCT/US2016/054729 dated Mar. 20, 2017.

* cited by examiner

COMPOSITIONS AND METHODS FOR INHIBITING GENE EXPRESSION OF LPA

BACKGROUND

Lipoprotein(a) [Lp(a)] is a heterogeneous low density lipoprotein (LDL)-like particle containing a lipid core and apolipoprotein B (apoB-100) with a unique constituent, apolipoprotein (a) (apo(a)), that is attached to apoB-100 through a disulfide bond.

The apo(a) gene (LPA) is expressed predominantly in the liver and expression is restricted to human and non-human primates. Lp(a) levels in humans are genetically defined and do not change significantly with diet, exercise, or other lifestyle changes. LPA varies in length depending upon the number of Kringle KIV2 domains present and its expression is inversely correlated with the number of domains present. Normal Lp(a) levels range from 0.1-25 mg/dl, with about 25% of the population in the United States of America having Lp(a) levels of 30 mg/dl or higher.

Analysis of Lp(a) levels in multiple studies have implicated high Lp(a) levels as an independent risk factor for cardiovascular disease, stroke, and other related disorders including atherosclerotic stenosis. In addition, genome-wide association analyses have also implicated LPA as a genetic risk factor for diseases such as atherosclerotic stenosis.

When therapeutic lipoprotein apheresis is used to lower both Lp(a) and LDL levels in hyperlipidemic patients, significant reductions of cardiovascular events have been observed. Therefore there exists a need for therapeutics and treatments related to these and other LPA-related diseases.

SUMMARY

Described herein are LPA (also termed apo(a)) RNA interference (RNAi) agents (also termed RNAi trigger, or trigger) and compositions containing LPA RNAi agents for selectively and efficiently inhibiting expression of the LPA gene. LPA is the name of the gene which encodes apolipoprotein (a) (apo(a)), a key component of the lipoprotein (a) particle (Lp(a)). The LPA RNAi agents described herein can be used in the prevention or treatment or the preparation of a medicament for the prevention or treatment of diseases including, but not limited to: Berger's disease, peripheral artery disease, coronary artery disease, metabolic syndrome, acute coronary syndrome, aortic valve stenosis, aortic valve regurgitation, aortic dissection, retinal artery occlusion, cerebrovascular disease, mesenteric ischemia, superior mesenteric artery occlusion, renal artery stenosis, stable/unstable angina, acute coronary syndrome, heterozygous or homozygous familial hypercholesterolemia, hyperapobetalipoproteinemia, cerebrovascular atherosclerosis, cerebrovascular disease, and venous thrombosis.

Each LPA RNAi agent includes at least a sense strand and an antisense strand. The sense strand and the antisense strand can be partially, substantially, or fully complementary to each other. The length of the RNAi agent sense and antisense strands described herein each can be 17 to 30 nucleotides in length. In some embodiments, the sense and antisense strands are independently 17 to 26 nucleotides in length. The sense and antisense strands can be either the same length or different lengths. The RNAi agents described herein, upon delivery to a cell expressing the LPA gene, inhibit the expression of the LPA gene in vitro or in vivo.

A sense strand of an LPA RNAi agent comprises a nucleotide sequence having at least 90% identity over a core stretch of at least 17 consecutive nucleotides to a sequence in an LPA mRNA. In some embodiments, the sense strand nucleotide sequence having at least 90% identity to a sequence in the LPA mRNA is 17, 18, 19, 20, 21, 22, or 23 nucleotides in length. An antisense strand of an LPA RNAi agent comprises a nucleotide sequence having at least 90% complementary over a core stretch of at least 16 consecutive nucleotides to a sequence in the LPA mRNA and the corresponding sense strand. In some embodiments, the antisense strand nucleotide sequence having at least 90% complementarity to a sequence in the LPA mRNA or the corresponding sense strand is 17, 18, 19, 20, 21, 22, or 23 nucleotides in length.

In some embodiments, one or more LPA RNAi agents are delivered to target cells or tissues using any oligonucleotide delivery technology known in the art. Nucleic acid delivery methods include, but are not limited to, by encapsulation in liposomes, by iontophoresis, or by incorporation into other vehicles, such as hydrogels, cyclodextrins, biodegradable nanocapsules, and bioadhesive microspheres, proteinaceous vectors or Dynamic Polyconjugates™ (DPCs (see, for example WO 2000/053722, WO 2008/0022309, WO 2011/104169, and WO 2012/083185, each of which is incorporated herein by reference). In some embodiments, an LPA RNAi agent is conjugated to a targeting group. In some embodiments, the targeting group can include a cell receptor ligand, such as a galactose cluster, including a galactose cluster comprising an N-acetyl-galactosamine trimer.

In some embodiments are described pharmaceutical compositions comprising one or more LPA RNAi agents. In some embodiments, an LPA RNAi agent is optionally combined with one or more additional (i.e., second, third, etc.) therapeutics. An additional therapeutic can be another LPA RNAi agent (e.g., an LPA RNAi agent which targets a different sequence within the LPA target). An additional therapeutic can also be a small molecule drug, antibody, antibody fragment, and/or vaccine. The LPA RNAi agents, with or without the one or more additional therapeutics, can be combined with one or more excipients to form pharmaceutical compositions.

In some embodiments, compositions for delivering an LPA RNAi agent to a liver cell, particularly hepatocytes, in vivo are described, comprising: an LPA RNAi agent conjugated to a targeting group. In some embodiments, the targeting group is a asialoglycoprotein ligand.

Also described are methods of treating a human subject having a pathological state or at risk of developing a pathological state mediated at least in part by LPA expression, the methods comprising the step(s) of administering to the subject a therapeutically effective amount of an LPA RNAi agent or LPA RNAi agent-containing composition. The method of treating a subject with an LPA RNAi agent or LPA RNAi agent-containing composition can optionally be combined with one or more steps of administering one or more additional (i.e., second) therapeutics or treatments. The LPA RNAi agent and additional therapeutics can be administered in a single composition or they may be administered separately. Examples of additional therapeutics include, but are not limited to, HMg Co-A reductase inhibitors (statins), ezetimibe, PCSK-9 inhibitors, CTEP inhibitors, therapies targeting ANGPTL3, therapies targeting APOC3, and niacin.

Use of the described LPA RNAi agents can be used in methods for therapeutic prevention or treatment of diseases including, but not limited to: Berger's disease, peripheral artery disease, coronary artery disease, metabolic syndrome, acute coronary syndrome, aortic valve stenosis, aortic valve regurgitation, aortic dissection, retinal artery occlusion, cerebrovascular disease, mesenteric ischemia, superior mesenteric artery occlusion, renal artery stenosis, stable/unstable angina, acute coronary syndrome, heterozygous or homozygous familial hypercholesterolemia, hyperapobetalipoproteinemia, cerebrovascular atherosclerosis, cerebrovascular disease, and venous thrombosis. Such methods comprise administration of an LPA RNAi agent as described herein to a subject, e.g., a human or animal subject.

The pharmaceutical compositions can be administered in a number of ways depending upon whether local or systemic treatment is desired and upon the area to be treated. Administration can be made by any way commonly known in the art, such as, but not limited to, topical (e.g., by a transdermal patch), pulmonary (e.g., by inhalation or insufflation of powders or aerosols, including by nebulizer, intratracheal, intranasal), epidermal, transdermal, oral or parenteral. Parenteral administration includes, but is not limited to, intravenous, intraarterial, subcutaneous, intraperitoneal or intramuscular injection or infusion; subdermal (e.g., via an implanted device), intracranial, intraparenchymal, intrathecal, and intraventricular, administration. In some embodiments, the pharmaceutical compositions described herein are administered by subcutaneous injection.

The described LPA RNAi agents and/or compositions can be used in methods for therapeutic treatment of diseases, including but not limited to: Berger's disease, peripheral artery disease, coronary artery disease, metabolic syndrome, acute coronary syndrome, aortic valve stenosis, aortic valve regurgitation, aortic dissection, retinal artery occlusion, cerebrovascular disease, mesenteric ischemia, superior mesenteric artery occlusion, renal artery stenosis, stable/unstable angina, acute coronary syndrome, heterozygous or homozygous familial hypercholesterolemia, hyperapobetalipoproteinemia, cerebrovascular atherosclerosis, cerebrovascular disease, and venous thrombosis. Such methods comprise administration of an LPA RNAi agent as described herein to a subject, e.g., a human or animal subject.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DETAILED DESCRIPTION

Figure 1:
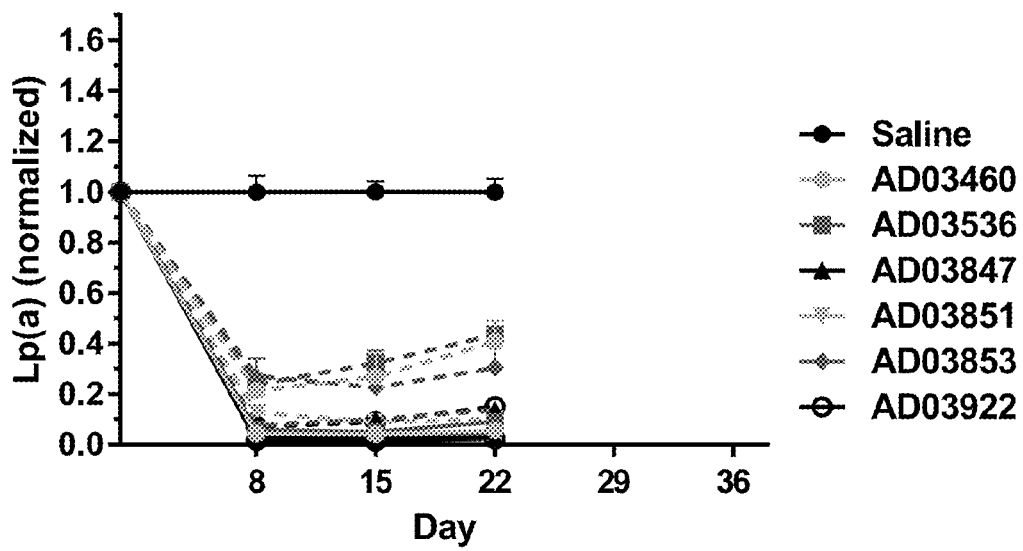
FIG. 1. Graph illustrating serum Lp(a) protein levels in Lp(a) transgenic (Tg) mice following a single subcutaneous administration of 0.5 mg/kg (dashed line) or 2 mg/kg (solid line) of indicated LPA RNAi agent. Lp(a) levels were normalized to day 1 and saline control.

Described herein are RNAi agents for inhibiting expression of the LPA gene (referred to herein as LPA RNAi agents). The RNAi agents described herein, upon delivery to a cell expressing the LPA gene, inhibit or knockdown expression of LPA in vitro and/or in vivo through the biological process of RNA interference (RNAi). As used herein, unless specifically noted otherwise, LPA may refer to an LPA gene, an LPA mRNA, or an Lp(a) protein, as appropriate.

An LPA RNAi agent comprises a sense strand and an antisense strand. The sense strand and antisense strand each contain a core sequence 17-23 nucleobases in length. An antisense strand core sequence is 100% (perfectly) complementary or at least 90% (substantially) complementary to a nucleotide sequence (sometimes referred to, e.g., as a target sequence) present in an LPA mRNA. A sense strand core sequence is 100% (perfectly) complementary or at least 90% (substantially) complementary to a sequence in the antisense strand and thus the sense strand core sequence is perfectly identical or at least 90% identical to a nucleotide sequence (target sequence) present in the LPA mRNA. A sense strand core sequence can be the same length as a corresponding antisense core sequence or it can be a different length. In some embodiments, the antisense strand core sequence is 17, 18, 19, 20, 21, 22, or 23 nucleotides in length. In some embodiments, the sense strand core sequence is 17, 18, 19, 20, 21, 22, or 23 nucleotides in length.

LPA RNAi agent sense and antisense strands anneal to form a duplex. A sense strand and an antisense strand of an LPA RNAi agent are partially, substantially, or fully complementary to each other. Within the complementary duplex region, the sense strand core sequence is at least 90% complementary or 100% complementary to the antisense core sequence. In some embodiments, the sense strand core sequence contains a sequence of at least 17, at least 18, at least 19, at least 20, or at least 21 nucleotides that is at least 90% or 100% complementary to a corresponding 17, 18, 19, 20, or 21 nucleotide sequence of the antisense strand core sequence (i.e., the sense strand and antisense core sequences of an LPA RNAi agent have a region of at least 17, at least 18, at least 19, at least 20, or at least 21 nucleotides that is at least 90% base paired or 100% base paired.)

As used herein, and unless otherwise indicated, the term "complementary," when used to describe a first nucleotide sequence (e.g., RNAi agent sense strand or LPA mRNA) in relation to a second nucleotide sequence (e.g., RNAi agent antisense strand), refers to the ability of an oligonucleotide or polynucleotide comprising the first nucleotide sequence to hybridize (form base pair hydrogen bonds) and form a duplex or double helical structure under certain conditions with an oligonucleotide or polynucleotide comprising the second nucleotide sequence. Complementary sequences include Watson-Crick base pairs or non-Watson-Crick base pairs and include natural or modified nucleotides or nucleotide mimics as long as the above requirements with respect to their ability to hybridize are fulfilled. "Perfectly complementary" or "fully complementary" means that all (100%) of the bases in a contiguous sequence of a first polynucleotide will hybridize with the same number of bases in a contiguous sequence of a second polynucleotide. The contiguous sequence may comprise all or a part of a first or second nucleotide sequence. As used herein, "partial complementary" means that in a hybridized pair of nucleobase sequences, at least 70% of the bases in a contiguous sequence of a first polynucleotide will hybridize with the same number of bases in a contiguous sequence of a second polynucleotide. As used herein, "substantial complementary" means that in a hybridized pair of nucleobase sequences, at least 85% of the bases in a contiguous sequence of a first polynucleotide will hybridize with the same number of bases in a contiguous sequence of a second polynucleotide. The terms "complementary", "fully complementary" and "substantially complementary" as used herein may be used with respect to the base matching between the sense strand and the antisense strand of an RNAi agent, or between the antisense strand of an RNAi agent and a sequence of an LPA mRNA. Sequence identity or complementarity is independent of modification. For the purposes of determining identity or complementarity, for example, a and Af are complementary to U (or T) and identical to A.

The length of the LPA RNAi agent sense and antisense strands described herein are independently 17 to 30 nucleotides in length. In some embodiments, the sense and antisense strands are independently 17 to 26 nucleotides in length. In some embodiments, the sense and antisense strands are 19-26 nucleotides in length. In some embodiments, the described RNAi agent sense and antisense strands are independently 17, 18, 19, 20, 21, 22, 23, 24, 25, or 26 nucleotides in length. The sense and antisense strands can be either the same length or they can be different lengths. In some embodiments, a sense strand and an antisense strand are each 26 nucleotides in length. In some embodiments, a sense strand is 23 nucleotides in length and an antisense strand is 21 nucleotides in length. In some embodiments, a sense strand is 22 nucleotides in length and an antisense strand is 21 nucleotides in length. In some embodiments, a sense strand is 21 nucleotides in length and an antisense strand is 21 nucleotides in length. In some embodiments, a sense strand is 19 nucleotides in length and an antisense strand is 21 nucleotides in length.

The sense strand and/or the antisense strand may optionally and independently contain an additional 1, 2, 3, 4, 5, or 6 nucleotides (extension) at the 3' end, the 5' end, or both the 3' and 5' ends of the core sequences. The antisense strand additional nucleotides, if present, may or may not be complementary to the corresponding sequence in the LPA mRNA. The sense strand additional nucleotides, if present, may or may not be identical to the corresponding sequence in the LPA mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core sequence and/or antisense strand core sequence. The extension nucleotides on a sense strand may or may not be complementary to nucleotides, either core sequence nucleotides or extension nucleotides, in the corresponding antisense strand. Conversely, the extension nucleotides on an antisense strand may or may not be complementary to nucleotides, either core sequence nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, an LPA RNAi agent has an antisense strand having a 3' extension and a sense strand having a 5' extension.

In some embodiments an LPA RNAi agent comprises an antisense strand having a 3' extension of 1, 2, 3, 4, 5, or 6 nucleotides in length. In other embodiments, an LPA RNAi agent comprises an antisense strand having a 3' extension of 1, 2, or 3 nucleotides in length. In some embodiments, one or more of the antisense strand extension nucleotides comprise uracil or thymidine nucleotides or nucleotides which are complementary to the corresponding LPA mRNA sequence. In some embodiments, a 3' antisense strand extension includes or consists of, but is not limited to: Ab, AbAb, AUA, UGCUU, CUG, UG, UGCC, CUGCC, CGU, CUU, UGCCUA, CUGCCU, UGCCU, UGAUU, GCCUAU, T, TT (each listed 5' to 3').

In some embodiments, an LPA RNAi agent comprises an antisense strand having a 5' extension of 1, 2, 3, 4, or 5 nucleotides in length. In other embodiments, an LPA RNAi agent comprises an antisense strand having a 5' extension of 1 or 2 nucleotides in length. In some embodiments, one or more of the antisense strand extension nucleotides comprises uracil or thymidine nucleotides or nucleotides which are complementary to the corresponding LPA mRNA sequence. In some embodiments, the 5' antisense strand extension includes or consists of, but is no limited to, UA, TU, U, T, CUC (each listed 5' to 3'). An antisense strand may have any of the 3' extensions described above in combination with any of the 5' antisense strand extensions described, if present.

In some embodiments, an LPA RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides which correspond to nucleotides in the LPA mRNA sequence. In some embodiments, the 3' sense strand extension includes or consists of, but is no limited to: T, UUAb, UAb, Ab, UT, TT, UUT, TTT, or TTTT (each listed 5' to 3').

In some embodiments, an LPA RNAi agent comprises a sense strand having a 5' extension of 1, 2, 3, 4, 5, or 6 nucleotides in length. In some embodiments, one or more of the sense strand extension nucleotides comprise uracil or adenosine nucleotides or nucleotides which correspond to nucleotides in the LPA mRNA sequence. In some embodiments, the sense strand 5' extension can be, but is not limited to: CA, AUAGGC, AUAGG, AUAG, AUA, A, AA, AC, GCA, GGCA, GGC, UAUCA, UAUC, Ab, UCA, UAU (each listed 5' to 3'). A sense strand may have a 3' extension and/or a 5' extension.

Examples of nucleotide sequences used in forming LPA RNAi agents are provided in Tables 1, 2A, 2B, 3A, and 3B. As used herein, the term "sequence" or "nucleotide sequence" refers to a succession or order of nucleobases, nucleotides, and/or nucleosides, whether modified or unmodified, described with a succession of letters using the standard nucleotide nomenclature and the key for modified nucleotides described herein.

RNAi agents include, but are not limited to: short interfering RNAs (siRNAs), double-strand RNAs (dsRNA), micro RNAs (miRNAs), short hairpin RNAs (shRNA), and dicer substrates (e.g., U.S. Pat. Nos. 8,084,599, 8,349,809, and 8,513,207).

Unmodified LPA RNAi agent sense strand and antisense strand sequences are provided in Table 1. In forming LPA RNAi agents, each of the nucleotides in each of the sequences listed in Table 1 may be a modified nucleotide.

TABLE 1

Unmodified LPA RNAi agent antisense strand and sense strand sequences.

| Antisense strand base sequence 5' → 3' | SEQ ID NO. | Sense strand base sequence 5' → 3' | SEQ ID NO. |
|---|---|---|---|
| TCGGCAGUCCCUUCUGCGUTT | 1 | ACGCAGAAGGGACUGCCGAT | 190 |
| TGUAGCACUCCUGCACCCCTT | 2 | GGGGUGCAGGAGUGCUACAT | 191 |
| TAAUAAGGGGCUGCCACAGTT | 3 | CUGUGGCAGCCCCUUAUUAT | 192 |
| TUAACAAUAAGGGGCUGCCTT | 4 | GGCAGCCCCUUAUUGUUAAT | 193 |
| TGUAUAACAAUAAGGGGCUTT | 5 | AGCCCCUUAUUGUUAUACAT | 194 |
| TCGUAUAACAAUAAGGGGCTT | 6 | GCCCCUUAUUGUUAUACGAT | 195 |
| TCGUCUGAGCAUUGUGUCATT | 7 | UGACACAAUGCUCAGACGAT | 196 |
| TGCGUCUGAGCAUUGUGUCTT | 8 | GACACAAUGCUCAGACGCAT | 197 |
| TUGCGUCUGAGCAUUGUGUTT | 9 | ACACAAUGCUCAGACGCAAT | 198 |
| TUCUGCGUCUGAGCAUUGUTT | 10 | ACAAUGCUCAGACGCAGAAT | 199 |
| TGGAUCUGGAUUUCGGCAGTT | 11 | CUGCCGAAAUCCAGAUCCAT | 200 |
| TCAGGAUCUGGAUUUCGGCTT | 12 | GCCGAAAUCCAGAUCCUGAT | 201 |
| TCAUCUGAGCAUCGUGUCATT | 13 | UGACACGAUGCUCAGAUGAT | 202 |
| TGCAUCUGAGCAUCGUGUCTT | 14 | GACACGAUGCUCAGAUGCAT | 203 |
| TUGCAUCUGAGCAUCGUGUTT | 15 | ACACGAUGCUCAGAUGCAAT | 204 |
| TUCUGCAUCUGAGCAUCGUTT | 16 | ACGAUGCUCAGAUGCAGAAT | 205 |
| TAAAGCCUCUAGGCUUGGATT | 17 | UCCAAGCCUAGAGGCUUUAT | 206 |
| TGUACCCCGGGGUUUCCUTT | 18 | AGGAAACCCCGGGGUACAT | 207 |
| TUGUACCCCGGGGUUUCCTT | 19 | GGAAACCCCGGGGUACAAT | 208 |
| TCUGUACCCCGGGGUUUCTT | 20 | GAAACCCCGGGGUACAGAT | 209 |
| TUCCAUAAUGGUAGUAGCATT | 21 | UGCUACUACCAUUAUGGAAT | 210 |
| TGUCCAUAAUGGUAGUAGCTT | 22 | GCUACUACCAUUAUGGACAT | 211 |
| TCUCUGUCCAUAAUGGUAGTT | 23 | CUACCAUUAUGGACAGAGAT | 212 |
| TCGACUAUGCUGGUGUGGUTT | 24 | ACCACACCAGCAUAGUCGAT | 213 |
| TCCGACUAUGCUGGUGUGGTT | 25 | CCACACCAGCAUAGUCGGAT | 214 |
| TUCCGACUAUGCUGGUGUGTT | 26 | CACACCAGCAUAGUCGGAAT | 215 |
| TGGUCCGACUAUGCUGGUGTT | 27 | CACCAGCAUAGUCGGACCAT | 216 |
| TUUUCUGGGGUCCGACUAUTT | 28 | AUAGUCGGACCCCAGAAAAT | 217 |
| TUUUUCUGGGGUCCGACUATT | 29 | UAGUCGGACCCCAGAAAAAT | 218 |
| TGCGAAUCUCAGCAUCUGGTT | 30 | CCAGAUGCUGAGAUUCGCAT | 219 |
| TCCAAGGGCGAAUCUCAGCTT | 31 | GCUGAGAUUCGCCCUUGGAT | 220 |

TABLE 1-continued

Unmodified LPA RNAi agent antisense strand and sense strand sequences.

| Antisense strand base sequence 5' → 3' | SEQ ID NO. | Sense strand base sequence 5' → 3' | SEQ ID NO. |
|---|---|---|---|
| TACCAAGGGCGAAUCUCAGTT | 32 | CUGAGAUUCGCCCUUGGUAT | 221 |
| TCACCAAGGGCGAAUCUCATT | 33 | UGAGAUUCGCCCUUGGUGAT | 222 |
| TACACCAAGGGCGAAUCUCTT | 34 | GAGAUUCGCCCUUGGUGUAT | 223 |
| TCCUGACACUGGGAUCCAUTT | 35 | AUGGAUCCCAGUGUCAGGAT | 224 |
| TUGCAAGGACACUUGAUUCTT | 36 | GAAUCAAGUGUCCUUGCAAT | 225 |
| TUUGCAAGGACACUUGAUUTT | 37 | AAUCAAGUGUCCUUGCAAAT | 226 |
| TUUGCUCCGUUGGUGCUUCTT | 38 | GAAGCACCAACGGAGCAAAT | 227 |
| TAAUGAGCCUCGAUAACUCTT | 39 | GAGUUAUCGAGGCUCAUUAT | 228 |
| TGAAUGAGCCUCGAUAACUTT | 40 | AGUUAUCGAGGCUCAUUCAT | 229 |
| TGGAUAAUAUUCUGUUGUCTT | 41 | GACAACAGAAUAUUAUCCAT | 230 |
| TCCAUGGUAUAACACCAAGTT | 42 | CUUGGUGUUAUACCAUGGAT | 231 |
| TGAUCCAUGGUAUAACACCTT | 43 | GGUGUUAUACCAUGGAUCAT | 232 |
| TAUUGGGAUCCAUGGUAUATT | 44 | UAUACCAUGGAUCCCAAUAT | 233 |
| TCAUUGGGAUCCAUGGUAUTT | 45 | AUACCAUGGAUCCCAAUGAT | 234 |
| TACAUUGGGAUCCAUGGUATT | 46 | UACCAUGGAUCCCAAUGUAT | 235 |
| TGACAUUGGGAUCCAUGGUTT | 47 | ACCAUGGAUCCCAAUGUCAT | 236 |
| TGACAUUGUGUCAGGUUGCTT | 48 | GCAACCUGACACAAUGUCAT | 237 |
| TCACUGGACAUUGUGUCAGTT | 49 | CUGACACAAUGUCCAGUGAT | 238 |
| TACUUGAUUCUGUCACUGGTT | 50 | CCAGUGACAGAAUCAAGUAT | 239 |
| TGAGAAUGAGCCUCGAUAATT | 51 | UUAUCGAGGCUCAUUCUCAT | 240 |
| TCCAUUUGGGUAGUAUUCTT | 52 | AGAAUACUACCCAAAUGGAT | 241 |
| TCACCAUUUGGGUAGUAUUTT | 53 | AAUACUACCCAAAUGGUGAT | 242 |
| TCCACCAUUUGGGUAGUAUTT | 54 | AUACUACCCAAAUGGUGGAT | 243 |
| TAUAACACCAAGGGCGAAUTT | 55 | AUUCGCCCUUGGUGUUAUAT | 244 |
| TACUGGGAUCCAUGGUAUATT | 56 | UAUACCAUGGAUCCCAGUAT | 245 |
| TCACUGGGAUCCAUGGUAUTT | 57 | AUACCAUGGAUCCCAGUGAT | 246 |
| TACCACCGUGGGAGUUGUGTT | 58 | CACAACUCCCACGGUGGUAT | 247 |
| TCAAGACUGACAUGUUCUUTT | 59 | AAGAACAUGUCAGUCUUGAT | 248 |
| TGGGAGUUGUGAGGACACUTT | 60 | AGUGUCCUCACAACUCCCAT | 249 |
| TUCUCAGGUGGUGCUUGUUTT | 61 | AACAAGCACCACCUGAGAAT | 250 |
| TCACAGGGCUUUUCUCAGGTT | 62 | CCUGAGAAAAGCCCUGUGAT | 251 |
| TGAUGCCAGUGUGGUAUCATT | 63 | UGAUACCACACUGGCAUCAT | 252 |
| TUGAUGCCAGUGUGGUAUCTT | 64 | GAUACCACACUGGCAUCAAT | 253 |
| TGACACCUGAUUCUGUUUCTT | 65 | GAAACAGAAUCAGGUGUCAT | 254 |
| TGGACACCUGAUUCUGUUUTT | 66 | AAACAGAAUCAGGUGUCCAT | 255 |
| TCUAGGACACCUGAUUCUGTT | 67 | CAGAAUCAGGUGUCCUAGAT | 256 |
| TAUAAGGGGCUGCCACAGGTT | 68 | CCUGUGGCAGCCCCUUAUAT | 257 |

TABLE 1-continued

Unmodified LPA RNAi agent antisense strand and sense strand sequences.

| Antisense strand base sequence 5' → 3' | SEQ ID NO. | Sense strand base sequence 5' → 3' | SEQ ID NO. |
| --- | --- | --- | --- |
| TAACAAUAAGGGGCUGCCATT | 69 | UGGCAGCCCCUUAUUGUUAT | 258 |
| TGUCCGACUAUGCUGGUGUTT | 70 | ACACCAGCAUAGUCGGACAT | 259 |
| TUCUCAGCAUCUGGAUUCCTT | 71 | GGAAUCCAGAUGCUGAGAAT | 260 |
| TCGAAUCUCAGCAUCUGGATT | 72 | UCCAGAUGCUGAGAUUCGAT | 261 |
| TAAGGGCGAAUCUCAGCAUTT | 73 | AUGCUGAGAUUCGCCCUUAT | 262 |
| TUGACACUGGGAUCCAUGGTT | 74 | CCAUGGAUCCCAGUGUCAAT | 263 |
| TCCGUUGGUGCUUCUUCAGTT | 75 | CUGAAGAAGCACCAACGGAT | 264 |
| TCUUGAUUCUGUCACUGGATT | 76 | UCCAGUGACAGAAUCAAGAT | 265 |
| TCACCGUGGGAGUUGUGAGTT | 77 | CUCACAACUCCCACGGUGAT | 266 |
| TUCUAGGACACCUGAUUCUTT | 78 | AGAAUCAGGUGUCCUAGAAT | 267 |
| TAGUCUCUAGGACACCUGATT | 79 | UCAGGUGUCCUAGAGACUAT | 268 |
| TCAAUAAGGGGCUGCCACATT | 80 | UAUAGCCCCUUAUUGUUAUACAT | 269 |
| TCUGCGUCUGAGCAUUGUGTT | 81 | UAUGCCCCUUAUUGUUAUACGAT | 270 |
| TACAGGAUCUGGAUUUCGGTT | 82 | UAUGACACAAUGCUCAGACGCAT | 271 |
| TCCGGGGUUUCCUCAGUCTT | 83 | UAUACACAAUGCUCAGACGCAAT | 272 |
| TUGUCCAUAAUGGUAGUAGTT | 84 | UAUUUAUCGAGGCUCAUUCUCAT | 273 |
| TUCUGUCCAUAAUGGUAGUTT | 85 | UAUGAAACAGAAUCAGGUGUCAT | 274 |
| TACUCUGUCCAUAAUGGUATT | 86 | UAUACACCAGCAUAGUCGGACAT | 275 |
| TAACUCUGUCCAUAAUGGUTT | 87 | UAUUCCAGAUGCUGAGAUUCGAT | 276 |
| TGGGCGAAUCUCAGCAUCUTT | 88 | UAUAUGCUGAGAUUCGCCCUUAT | 277 |
| TAGGGCGAAUCUCAGCAUCTT | 89 | UAUCCAUGGAUCCCAGUGUCAAT | 278 |
| TAACACCAAGGGCGAAUCUTT | 90 | UGUGGCAGCCCCUUAUUGAT | 279 |
| TAGGACACUUGAUUCUGUCTT | 91 | CACAAUGCUCAGACGCAGAT | 280 |
| TGGACCAAGACUGACAUGUTT | 92 | CCGAAAUCCAGAUCCUGUAT | 281 |
| TGGUCAGGCCACCAUUUGGTT | 93 | GACUGAGGAAACCCCCGGAT | 282 |
| TAUCCAUGGUAUAACACCATT | 94 | CUACUACCAUUAUGGACAAT | 283 |
| TGGGAUCCAUGGUAUAACATT | 95 | ACUACCAUUAUGGACAGAAT | 284 |
| TUGGACAUUGUGUCAGGUUTT | 96 | UACCAUUAUGGACAGAGUAT | 285 |
| TAUUCUGUCACUGGACAUUTT | 97 | ACCAUUAUGGACAGAGUUAT | 286 |
| TGGUGCUUGUUCAGAAACATT | 98 | AGAUGCUGAGAUUCGCCCAT | 287 |
| TGGAGAAUGAGCCUCGAUATT | 99 | GAUGCUGAGAUUCGCCCUAT | 288 |
| TGUGGAGAAUGAGCCUCGATT | 100 | AGAUUCGCCCUUGGUGUUAT | 289 |
| TCCGUGGGAGUUGUGAGGATT | 101 | GACAGAAUCAAGUGUCCUAT | 290 |
| TGGACCACCGUGGGAGUUGTT | 102 | ACAUGUCAGUCUUGGUCCAT | 291 |
| TUGCUUGUUCAGAAGGAGCTT | 103 | CCAAAUGGUGGCCUGACCAT | 292 |
| TCUGAUGCCAGUGUGGUAUTT | 104 | UGGUGUUAUACCAUGGAUAT | 293 |
| TUAGGACACCUGAUUCUGUTT | 105 | UGUUAUACCAUGGAUCCCAT | 294 |
| TCUCUAGGACACCUGAUUCTT | 106 | AACCUGACACAAUGUCCAAT | 295 |

TABLE 1-continued

Unmodified LPA RNAi agent antisense strand and sense strand sequences.

| Antisense strand base sequence 5' → 3' | SEQ ID NO. | Sense strand base sequence 5' → 3' | SEQ ID NO. |
|---|---|---|---|
| TCUCUAGGACACCUGAUUTT | 107 | AAUGUCCAGUGACAGAAUAT | 296 |
| TGUCUCUAGGACACCUGAUTT | 108 | UGUUUCUGAACAAGCACCAT | 297 |
| TGAGAAUGAGCCUCGAUAACUCUUAU | 109 | UAUCGAGGCUCAUUCUCCAT | 298 |
| TGACACCUGAUUCUGUUUCUGAGUAU | 110 | UCGAGGCUCAUUCUCCACAT | 299 |
| TCGUAUAACAAUAAGGGGCUGCCUAU | 111 | UCCUCACAACUCCCACGGAT | 300 |
| TGCGUCUGAGCAUUGUGUCAGGUUAU | 112 | CAACUCCCACGGUGGUCCAT | 301 |
| TUGCGUCUGAGCAUUGUGUCAGGUAU | 113 | GCUCCUUCUGAACAAGCAAT | 302 |
| TAAGGGCGAAUCUCAGCAUCUGGUAU | 114 | AUACCACACUGGCAUCAGAT | 303 |
| UUAACAAUAAGGGGCUGCAb | 115 | ACAGAAUCAGGUGUCCUAAT | 304 |
| UGUAUAACAAUAAGGGGCAb | 116 | GAAUCAGGUGUCCUAGAGAT | 305 |
| UCGUAUAACAAUAAGGGGAb | 117 | AAUCAGGUGUCCUAGAGAAT | 306 |
| UGCGUCUGAGCAUUGUGUAb | 118 | AUCAGGUGUCCUAGAGACAT | 307 |
| UUGCGUCUGAGCAUUGUGAb | 119 | UAUAUAGUUAUCGAGGCUCAUUCUCA | 308 |
| UCAGGAUCUGGAUUUCGGAb | 120 | UAUAUCAGAAACAGAAUCAGGUGUCA | 309 |
| UUGCAUCUGAGCAUCGUGAb | 121 | UAUAUCAGCCCCUUAUUGUUAUACGA | 310 |
| UCGACUAUGCUGGUGUGGAb | 122 | UAUAUCUGACACAAUGCUCAGACGCA | 311 |
| UUUUCUGGGGUCCGACUAAb | 123 | UAUAUUGACACAAUGCUCAGACGCAA | 312 |
| UGCGAAUCUCAGCAUCUGAb | 124 | UAUAUAGAUGCUGAGAUUCGCCCUUA | 313 |
| UUGCAAGGACACUUGAUUAb | 125 | GCAGCCCCUUAUUGUUAA | 314 |
| UAAUGAGCCUCGAUAACUAb | 126 | GCCCCUUAUUGUUAUACA | 315 |
| UGAAUGAGCCUCGAUAACAb | 127 | CCCCUUAUUGUUAUACGA | 316 |
| UGACAUUGUGUCAGGUUGAb | 128 | ACACAAUGCUCAGACGCA | 317 |
| UGAGAAUGAGCCUCGAUAAb | 129 | CACAAUGCUCAGACGCAA | 318 |
| UCCAUUUGGGUAGUAUUCAb | 130 | CCGAAAUCCAGAUCCUGA | 319 |
| UCACCAUUUGGGUAGUAUAb | 131 | CACGAUGCUCAGAUGCAA | 320 |
| UGACACCUGAUUCUGUUUAb | 132 | CCACACCAGCAUAGUCGA | 321 |
| UGGACACCUGAUUCUGUUAb | 133 | UAGUCGGACCCCAGAAAA | 322 |
| UUAACAAUAAGGGGCUGAbAb | 134 | CAGAUGCUGAGAUUCGCA | 323 |
| UGUAUAACAAUAAGGGGAbAb | 135 | AAUCAAGUGUCCUUGCAA | 324 |
| UCGUAUAACAAUAAGGGAbAb | 136 | AGUUAUCGAGGCUCAUUA | 325 |
| UGCGUCUGAGCAUUGUGAbAb | 137 | GUUAUCGAGGCUCAUUCA | 326 |
| UUGCGUCUGAGCAUUGUAbAb | 138 | CAACCUGACACAAUGUCA | 327 |
| UCAGGAUCUGGAUUUCGAbAb | 139 | UAUCGAGGCUCAUUCUCA | 328 |
| UUGCAUCUGAGCAUCGUAbAb | 140 | GAAUACUACCCAAAUGGA | 329 |
| UCGACUAUGCUGGUGUGAbAb | 141 | AUACUACCCAAAUGGUGA | 330 |
| UUUUCUGGGGUCCGACUAbAb | 142 | AAACAGAAUCAGGUGUCA | 331 |
| UGCGAAUCUCAGCAUCUAbAb | 143 | AACAGAAUCAGGUGUCCA | 332 |

TABLE 1-continued

Unmodified LPA RNAi agent antisense strand and sense strand sequences.

| Antisense strand base sequence 5' → 3' | SEQ ID NO. | Sense strand base sequence 5' → 3' | SEQ ID NO. |
|---|---|---|---|
| UUGCAAGGACACUUGAUAbAb | 144 | CAGCCCCUUAUUGUUAA | 333 |
| UAAUGAGCCUCGAUAACAbAb | 145 | CCCCUUAUUGUUAUACA | 334 |
| UGAAUGAGCCUCGAUAAAbAb | 146 | CCCUUAUUGUUAUACGA | 335 |
| UGACAUUGUGUCAGGUUAbAb | 147 | CACAAUGCUCAGACGCA | 336 |
| UGAGAAUGAGCCUCGAUAbAb | 148 | ACAAUGCUCAGACGCAA | 337 |
| UCCAUUUGGGUAGUAUUAbAb | 149 | CGAAAUCCAGAUCCUGA | 338 |
| UCACCAUUUGGGUAGUAAbAb | 150 | ACGAUGCUCAGAUGCAA | 339 |
| UGACACCUGAUUCUGUUAbAb | 151 | CACACCAGCAUAGUCGA | 340 |
| UGGACACCUGAUUCUGUAbAb | 152 | AGUCGGACCCCAGAAAA | 341 |
| UGAGAAUGAGCCUCGAUAACUCUUAU | 153 | AGAUGCUGAGAUUCGCA | 342 |
| UGACACCUGAUUCUGUUUCUGAGUAU | 154 | AUCAAGUGUCCUUGCAA | 343 |
| UGAGAAUGAGCCUCGAUAACUCTUAU | 155 | GUUAUCGAGGCUCAUUA | 344 |
| UCGUAUAACAAUAAGGGGCUGCCUAU | 156 | UUAUCGAGGCUCAUUCA | 345 |
| UGAGAAUGAGCCUCGAUAATT | 157 | AACCUGACACAAUGUCA | 346 |
| UCGUAUAACAAUAAGGCGCUGCCUAU | 158 | AUCGAGGCUCAUUCUCA | 347 |
| UGAGAAUGAGCCUCGATAbAb | 159 | AAUACUACCCAAAUGGA | 348 |
| UGACACCUGAUUCUGTTAbAb | 160 | UACUACCCAAAUGGUGA | 349 |
| UCGUAUAACAAUAAGGGGCUGAUU | 161 | AACAGAAUCAGGUGUCA | 350 |
| UCGUAUAACAAUAAGGGGCUGCUU | 162 | ACAGAAUCAGGUGUCCA | 351 |
| UGAGAAUGAGCCUCGAUAACUCUU | 163 | UAUAUCAGCGCCUUAUUGUUAUACGA | 352 |
| UCGUAUAACAAUAAGGGGCUU | 164 | ATCGAGGCUCAUUCUCA | 353 |
| UGUAUAACAAUAAGGGG | 165 | UCAGCCCCUUAUUGUUAUACGAUUAb | 354 |
| UCGUAUAACAAUAAGGG | 166 | UCAGCCCCUUAUUGUUAUACGAAb | 355 |
| UGAGAAUGAGCCUCGAT | 167 | UAGUUAUCGAGGCUCAUUCUCAUUAb | 356 |
| UGACACCUGAUUCUGTT | 168 | AbGCCCCUUAUUGUUAUACGAUUAb | 357 |
| TUCGUAUAACAAUAAGGGGCUGCCUA | 169 | AUAUCAGCCCCUUAUUGUUAUACGAT | 358 |
| UAUCGUAUAACAAUAAGGGGCUGCCU | 170 | UAUCAGCCCCUUAUUGUUAUACGAUT | 359 |
| TCCGUAUAACAAUAAGGGGCUGCCUA | 171 | AUAUAGUUAUCGAGGCUCAUUCUCAT | 360 |
| CUCCGUAUAACAAUAAGGGGCUGCCU | 172 | UAUAGUUAUCGAGGCUCAUUCUCAUT | 361 |
| TUGAGAAUGAGCCUCGAUAACUCUUA | 173 | AbUUAUCGAGGCUCAUUCUCAUUAb | 362 |
| UAUGAGAAUGAGCCUCGAUAACUCUU | 174 | UAUAUAAUUAUCGAGGCUCAUUCUCAAb | 363 |
| TGGAGAAUGAGCCUCGAUAACUCUUA | 175 | GGCAGCCCCUUAUUGUUAUACGATT | 364 |
| GUGGAGAAUGAGCCUCGAUAACUCUU | 176 | GGCAGCCCCUUAUUGUUAUACGAUUT | 365 |
| UGAGAAUGAGCCUCGAUAAUU | 177 | CAGCCCCUUAUUGUUAUACGATTTT | 366 |
| TCGUAUAACAAUAAGGGGCUU | 178 | GCGAUAGUUAUCGAGGCUCAUUCUCA | 367 |
| UGAGAAUGAGCCUCGAUAAUUAUAUA | 179 | UGAAUAGUUAUCGAGGCUCAUUCUCA | 368 |
| UCGUAUAACAAUAAGGGGCUGCC | 180 | AUCUAGUUAUCGAGGCUCAUUCUCA | 369 |
| TUCGUAUAACAAUAAGGGGCUGCC | 181 | UAUAAAGUUAUCGAGGCUCAUUCUCA | 370 |

TABLE 1-continued

Unmodified LPA RNAi agent antisense strand and sense strand sequences.

| Antisense strand base sequence 5' → 3' | SEQ ID NO. | Sense strand base sequence 5' → 3' | SEQ ID NO. |
|---|---|---|---|
| TUCGUAUAACAAUAAGGGGCUG | 182 | AGCCCCUUAUUGUUAUACGAAb | 371 |
| UGAGAAUGAGCCUCGAUAACUAUCGC | 183 | AAGCCCCUUAUUGUUAUACGAAb | 372 |
| UGAGAAUGAGCCUCGAUAACUAUUCA | 184 | GCAGCCCCUUAUUGUUAUACGAAb | 373 |
| UGAGAAUGAGCCUCGAUAACUACGAU | 185 | UAUAUAGUUAUCGAGGCUCAUUCUCAAb | 374 |
| UCGUAUAACAAUAAGGGGCGU | 186 | ACGCCCCUUAUUGUUAUACGAAb | 375 |
| UCGUAUAACAAUAAGGGGCUGCCU | 187 | GCCCCUUAUUGUUAUACGAUUAb | 376 |
| UCGUAUAACAAUAAGGGGCUG | 188 | AGCCCCUUAUUGUUAUACGAUUAb | 377 |
| TCGUAUAACAAUAAGGGGCUGCUU | 189 | AAGCCCCUUAUUGUUAUACGAUUAb | 378 |
| TCGUAUAACAAUAAGGGGC | 1242 | UAUCAGCCCCUUAUUGUUAUACGA | 379 |
| UCGUAUAACAAUAAGGGG | 1244 | UAGCAGCCCCUUAUUGUUAUACGA | 380 |
| UCGUAUAACAAUAAGGG | 1246 | GCAGCCCCUUAUUGUUAUACGA | 381 |
| TGAGAAUGAGCCUCGAUAA | 1248 | AUAAGAGUUAUCGAGGCUCAUUCUCA | 382 |
| UGAGAAUGAGCCUCGAUA | 1250 | AUAGGCAGCCCCUUAUUGUUAUACGA | 383 |
| UGAGAAUGAGCCUCGAU | 1252 | CAGCCCCUUAUUGUUAUACGA | 384 |
| UGUAUAACAAUAAGGGG | 1254 | UAUAUCAGCCCCTUAUUGUUAUACGA | 385 |
| CGUAUAACAAUAAGGGGC | 1280 | AbGCCCCUUAUUGUUAUACGAUUAb | 1241 |
| GAGAAUGAGCCUCGAUAA | 1281 | GCCCCUUAUUGUUAUACGA | 1243 |
| UCGUAUAACAAUAAGGGGC | 1282 | CCCCUUAUUGUUAUACGA | 1245 |
| UGAGAAUGAGCCUCGAUAA | 1283 | CCCUUAUUGUUAUACGA | 1247 |
| | | UUAUCGAGGCUCAUUCUCA | 1249 |
| | | UAUCGAGGCUCAUUCUCA | 1251 |
| | | AUCGAGGCUCAUUCUCA | 1253 |
| | | CCCCUUAUUGUUAUACA | 1255 |
| | | UUAUCGAGGCUCAUUCUCA | 1258 |
| | | GCCCCUUAUUGUUAUACGA | 1259 |
| | | ACAGCCCCUUAUUGUUAUACGA | 1260 |
| | | AAAGCCCCUUAUUGUUAUACGA | 1261 |
| | | GCCCCUUAUUGUUAUACG | 1284 |
| | | UUAUCGAGGCUCAUUCUC | 1285 |

Ab = abasic nucleotide

The LPA RNAi agents described herein are formed by annealing an antisense strand with a sense strand. A sense strand containing a sequence listed in Table 1 or Table 2B can be hybridized to any antisense strand containing a sequence listed in Table 1 or Table 2A provided the two sequences have a region of at least 90% complementarity over a contiguous 16, 17, 18, 19, 20, or 21 nucleotide sequence.

In some embodiments, an LPA RNAi agent antisense strand comprises a nucleotide sequence of any of the sequences in Table 1. In some embodiments, an LPA RNAi agent antisense strand comprises the sequence of nucleotides 1-17, 2-17, 1-18, 2-18, 1-19, 2-19, 1-20, 2-20, 1-21, 2-21, 1-22, 2-22, 1-23, 2-23, 1-24, 2-24, 1-25, 2-25, 1-26, or 2-26 of any of the sequences in Table 1. In some embodiments, an LPA RNAi agent sense strand comprises the nucleotide sequence of any of the sequences in Tables 1. In some embodiments, an LPA RNAi agent sense strand comprises the sequence of nucleotides 1-17, 2-17, 1-18, 2-18, 1-19, 2-19, 1-20, 2-20, 1-21, 2-21, 1-22, 2-22, 1-23, 2-23, 1-24, 2-24, 1-25, 2-25, 1-26, or 2-26 of any of the sequences in Table 1.

In some embodiments, the sense and antisense strands of the RNAi agents described herein contain the same number of nucleotides. In some embodiments the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a blunt end refers to an end of a double stranded RNAi agent in which the terminal nucleotides of the two annealed strands are complementary (form a complementary base-pair). In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands from a pair (i.e. do not form an overhang) but are not complementary (i.e. form a non-complementary pair). As used herein, an overhang is a stretch of one or more unpaired nucleotides at the end of one strand of a double stranded RNAi agent. The unpaired nucleotides may be on the sense strand or the antisense strand, creating either 3' or 5' overhangs. In some embodiments the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends.

A nucleotide base (or nucleobase) is a heterocyclic pyrimidine or purine compound which is a constituent of all nucleic acids and includes adenine (A), guanine (G), cytosine (C), thymine (T), and uracil (U). As used herein, the term "nucleotide" can include a modified nucleotide or nucleotide mimic, abasic site (Ab or X), or a surrogate replacement moiety.

In some embodiments, an LPA RNAi agent is prepared or provided as a salt, mixed salt, or a free-acid.

Modified Nucleotides

In some embodiments, an LPA RNAi agent contains one or more modified nucleotides. As used herein, a "modified nucleotide" is a nucleotide other than a ribonucleotide (2'-hydroxyl nucleotide). In some embodiments, at least 50%, at least 60%, at least 70%, at least 80%, at least 90%, at least 95%, or 100% of the nucleotides are modified. Modified nucleotides include, but are not limited to, deoxynucleotides, nucleotide mimics, abasic nucleotides (represented herein as X, Ab), 2'-modified nucleotides, 3' to 3' linkages (inverted) nucleotides (represented herein as invdN, invN, invn, invX, invAb, non-natural base-comprising nucleotides, bridged nucleotides, peptide nucleic acids (PNAs), 2',3'-seco nucleotide mimics (unlocked nucleobase analogues, represented herein as $N_{UNA}$ or NUNA), locked nucleotides (represented herein as $N_{LNA}$ or NLNA), 3'-O-Methoxy (2' internucleoside linked) nucleotides (represented herein as 3'-OMen), 2'-F-Arabino nucleotides (represented herein as NfANA or $Nf_{ANA}$), 5'-Me,2'-fluoro nucleotide (represented herein as 5Me-NO, morpholino nucleotides, vinyl phosphonate deoxyribonucleotides (represented herein as vpdN), vinyl phosphonate containing nucleotides, and cyclopropyl phosphonate containing nucleotides (cPrpN). 2'-modified nucleotides (i.e. a nucleotide with a group other than a hydroxyl group at the 2' position of the five-membered sugar ring) include, but are not limited to, 2'-O-methyl nucleotides (represented herein as a lower case letter 'n' in a nucleotide sequence), 2'-deoxy-2'-fluoro nucleotides (represented herein as Nf, also represented herein as 2'-fluoro nucleotide), 2'-deoxy nucleotides (represented herein as dN), 2'-methoxyethyl (2'-O-2-methoxylethyl) nucleotides (represented herein as NM or 2'-MOE), 2'-amino nucleotides, and 2'-alkyl nucleotides. It is not necessary for all positions in a given compound to be uniformly modified. Conversely, more than one modification may be incorporated in a single LPA RNAi agent or even in a single nucleotide thereof. The LPA RNAi agent sense strands and antisense strands may be synthesized and/or modified by methods known in the art. Modification at one nucleotide is independent of modification at another nucleotide.

Modified nucleotides also include nucleotides having modified nucleobases. Modified nucleobases include, but are not limited to, synthetic and natural nucleobases, 5-substituted pyrimidines, 6-azapyrimidines and N-2, N-6 and O-6 substituted purines, including 2-aminopropyladenine, 5-propynyluracil and 5-propynylcytosine, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine.

Modified Internucleoside Linkages

In some embodiments, one or more nucleotides of an LPA RNAi agent are linked by non-standard linkages or backbones (i.e. modified internucleoside linkages or modified backbones). In some embodiments, a modified internucleoside linkage is a non-phosphate-containing covalent internucleoside linkage. Modified internucleoside linkages or backbones include, but are not limited to, 5'-phosphorothioate group (represented herein as a lower case 's' before a nucleotide, as in sN, sn, sNf, or sdN), chiral phosphorothioates, thiophosphate, phosphorodithioates, phosphotriesters, aminoalkyl-phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkyl-phosphonates, thionoalkylphosphotriesters, morpholino linkages, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. In other embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide, sulfoxide and sulfone backbones; formacetyl and thioformacetyl backbones, methylene formacetyl and thioformacetyl backbones, alkene containing backbones, sulfamate backbones, methyleneimino and methylenehydrazino backbones, sulfonate and sulfonamide backbones, amide backbones; and others having mixed N, O, S, and CH$_2$ component parts.

In some embodiments, a sense strand of an LPA RNAi agent can contain 1, 2, 3, 4 phosphorothioate linkages, an antisense strand of an LPA RNAi agent can contain 1, 2, 3, or 4 phosphorothioate linkages, or both the sense strand and the antisense strand independently can contain 1, 2, 3, or 4 phosphorothioate linkages.

In some embodiments, an LPA RNAi agent sense strand contains two phosphorothioate internucleoside linkages. In some embodiments, the two phosphorothioate internucleoside linkages are between the nucleotides at positions 1-3 from the 3' end of the sense strand. In some embodiments, the two phosphorothioate internucleoside linkages are between the nucleotides at positions 1-3, 2-4, 3-5, 4-6, 4-5, or 6-8 from the 5' end of the sense strand. In some embodiments, an LPA RNAi agent antisense strand contains four phosphorothioate internucleoside linkages. In some embodiments, the four phosphorothioate internucleoside linkages are between the nucleotides at positions 1-3 from the 5' end of the sense strand and between the nucleotides at positions 19-21, 20-22, 21-23, 22-24, 23-25, or 24-26 from the 5' end. In some embodiments, an LPA RNAi agent contains two phosphorothioate internucleoside linkages in the sense strand and four phosphorothioate internucleoside linkages in the antisense strand.

In some embodiments, an LPA RNAi agent contains one or more modified nucleotides and one or more modified internucleoside linkages. In some embodiments, a 2'-modified nucleotide is combined with modified internucleoside linkage.

LPA RNAi Agents Having Modified Nucleotides

Examples of antisense strands containing modified nucleotides are provided in Table 2A. Examples of sense strands containing modified nucleotides are provided in Table 2B. In Tables 2A and 2B, the following notations are used to indicate modified nucleotides:

N=2'-OH (unmodified) ribonucleotide (capital letter without for d indication)
n=2'-OMe modified nucleotide
Nf=2'-fluoro modified nucleotide
dN=2'-deoxy nucleotides
N$_{UNA}$=2',3'-seco nucleotide mimics (unlocked nucleobase analogs)
N$_{LNA}$=locked nucleotide
Nf$_{ANA}$=2'-F-Arabino nucleotide
NM=2'-methoxy ethyl nucleotide
Ab=abasic ribose
(invdN)=inverted deoxyribonucleotide (3'-3' linked nucleotide)
(invAb)=inverted abasic nucleotide
(invn)=inverted 2'-OMe nucleotide
s=phosphorothioate linked nucleotide
p=phosphate
vpdN=vinyl phosphonate deoxyribonucleotide
(3'OMen)=3'-OMe nucleotide
(5Me-Nf)=5'-Me, 2'-fluoro nucleotide
cPrp=cyclopropyl phosphonate
epTcPr=see Table 4
epTM=see Table 4

In addition the following targeting groups and linking groups are listed in Tables 2A and 2B: (Alk-PEG5-C6), (C11-PEG3-NAG3), (C12), (C6-PEG4-NAG3), (C6-SS-Alk-Me), (Chol-TEG), (Dy540), (NAG13), (NAG18), (NAG24), (NAG25), (NAG26), (NAG27), (NAG28), (NAG29), (NAG30), (NAG31), (NAG32), (NAG33), (NAG34), (NAG35), (NAG36), (NAG37), (NAG4), (PAZ), (Sp18), (Steryl), (Alk-SMPT-C6). Each sense strand and/or antisense strand can have any of the above indicated targeting groups or linking groups, as well as other targeting or linking groups, conjugated to the 5' and/or 3' end of the sequence. The chemical structures for these groups are provided in Table 4.

TABLE 2A

LPA RNAi agent antisense strands having modified nucleotides.

| Antisense Strand ID | Antisense strand sequence 5' → 3' | SEQ ID NO. | SEQ ID NO. |
|---|---|---|---|
| AM01240-AS | dTCfgGfcAfgUfcCfcUfuCfuGfcGfudTsdT | 386 | 1 |
| AM01241-AS | dTGfuAfgCfaCfuCfcUfgCfaCfcCfcdTsdT | 387 | 2 |
| AM01242-AS | dTAfaUfaAfgGfgGfcUfgCfcAfcAfgdTsdT | 388 | 3 |
| AM01243-AS | dTUfaAfcAfaUfaAfgGfgGfcUfgCfcdTsdT | 389 | 4 |
| AM01244-AS | dTGfuAfuAfaCfaAfuAfaGfgGfcUfudTsdT | 390 | 5 |
| AM01245-AS | dTCfgUfaUfaAfcAfaUfaAfgGfgGfcdTsdT | 391 | 6 |
| AM01246-AS | dTCfgUfcUfgAfgCfaUfuGfuGfuCfadTsdT | 392 | 7 |
| AM01247-AS | dTGfcGfuCfuGfaGfcAfuUfgUfgUfcdTsdT | 393 | 8 |
| AM01248-AS | dTUfgCfgUfcUfgAfgCfaUfuGfuGfudTsdT | 394 | 9 |
| AM01249-AS | dTUfcUfgCfgUfcUfgAfgCfaUfuGfudTsdT | 395 | 10 |
| AM01250-AS | dTGfgAfuCfuGfgAfuUfuCfgGfcAfgdTsdT | 396 | 11 |
| AM01251-AS | dTCfaGfgAfuCfuGfgAfuUfuCfgGfcdTsdT | 397 | 12 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM01252-AS | dTCfaUfcUfgAfgCfaUfcGfuGfuCfadTsdT | 398 | 13 |
| AM01253-AS | dTGfcAfuCfuGfaGfcAfuCfgUfgUfcdTsdT | 399 | 14 |
| AM01254-AS | dTUfgCfaUfcUfgAfgCfaUfcGfuGfudTsdT | 400 | 15 |
| AM01255-AS | dTUfcUfgCfaUfcUfgAfgCfaUfcGfudTsdT | 401 | 16 |
| AM01256-AS | dTAfaAfgCfcUfcUfaGfgCfuUfgGfadTsdT | 402 | 17 |
| AM01257-AS | dTGfuAfcCfcCfgGfgGfgUfuUfcCfudTsdT | 403 | 18 |
| AM01258-AS | dTUfgUfaCfcCfcGfgGfgGfuUfuCfcdTsdT | 404 | 19 |
| AM01259-AS | dTCfuGfuAfcCfcCfgGfgGfgUfuUfcdTsdT | 405 | 20 |
| AM01260-AS | dTUfcCfaUfaAfuGfgUfaGfuAfgCfadTsdT | 406 | 21 |
| AM01261-AS | dTGfuCfcAfuAfaUfgGfuAfgUfaGfcdTsdT | 407 | 22 |
| AM01262-AS | dTCfuCfuGfuCfcAfuAfaUfgGfuAfgdTsdT | 408 | 23 |
| AM01263-AS | dTCfgAfcUfaUfgCfuGfuGfuGfgUfudTsdT | 409 | 24 |
| AM01264-AS | dTCfcGfaCfuAfuGfcUfgGfuGfuGfgdTsdT | 410 | 25 |
| AM01265-AS | dTUfcCfgAfcUfaUfgCfuGfuGfuGfgdTsdT | 411 | 26 |
| AM01266-AS | dTGfgUfcCfgAfcUfaUfgCfuGfuGfgdTsdT | 412 | 27 |
| AM01267-AS | dTUfuUfcUfgGfgGfuCfcGfaCfuAfudTsdT | 413 | 28 |
| AM01268-AS | dTUfuUfcUfgGfgGfuCfcGfaCfuAfadTsdT | 414 | 29 |
| AM01269-AS | dTGfcGfaAfuUfcUfaGfcAfuCfuGfgdTsdT | 415 | 30 |
| AM01270-AS | dTCfcAfaGfgGfcGfaAfuUfcUfcAfgdTsdT | 416 | 31 |
| AM01271-AS | dTAfcCfaAfgGfgCfgAfaUfcUfcAfgdTsdT | 417 | 32 |
| AM01272-AS | dTCfaCfcAfaGfgGfcGfaAfuUfcUfcdTsdT | 418 | 33 |
| AM01273-AS | dTAfcAfcCfaAfgGfgCfgAfaUfcUfcdTsdT | 419 | 34 |
| AM01274-AS | dTCfcUfgAfcAfcUfgGfgAfuCfcAfudTsdT | 420 | 35 |
| AM01275-AS | dTUfgCfaAfgGfaCfaCfuUfgAfuUfcdTsdT | 421 | 36 |
| AM01276-AS | dTUfuGfcAfaGfgAfcAfcUfuGfaUfudTsdT | 422 | 37 |
| AM01277-AS | dTUfuGfcUfcCfgUfuGfuGfcFfuUfcdTsdT | 423 | 38 |
| AM01278-AS | dTAfaUfgAfgCfcUfcGfaUfaAfcUfcdTsdT | 424 | 39 |
| AM01279-AS | dTGfaAfuGfaGfcCfuCfgAfuAfaCfudTsdT | 425 | 40 |
| AM01280-AS | dTGfgAfuAfaUfaUfcUfgUfuGfuUfcdTsdT | 426 | 41 |
| AM01281-AS | dTCfcAfuGfuAfaAfcAfcCfaAfgdTsdT | 427 | 42 |
| AM01282-AS | dTGfaUfcCfaUfgGfuAfuAfaCfaCfcdTsdT | 428 | 43 |
| AM01283-AS | dTAfuUfgGfgAfuCfcAfuGfuUfaUfadTsdT | 429 | 44 |
| AM01284-AS | dTCfaUfuGfgGfaUfcCfaUfgGfuAfudTsdT | 430 | 45 |
| AM01285-AS | dTAfcAfuUfgGfgAfuCfcAfuGfgUfadTsdT | 431 | 46 |
| AM01286-AS | dTGfaCfaUfuGfgGfaUfcCfaUfgGfudTsdT | 432 | 47 |
| AM01287-AS | dTGfaCfaUfuGfuGfuCfaGffUfuGfcdTsdT | 433 | 48 |
| AM01288-AS | dTCfaCfuGfgAfcAfuUfgUfgUfcAfgdTsdT | 434 | 49 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM01289-AS | dTAfcUfuGfaUfuCfuGfuCfaCfuGfgdTsdT | 435 | 50 |
| AM01290-AS | dTGfaGfaAfuGfaGfcCfuCfgAfuAfadTsdT | 436 | 51 |
| AM01291-AS | dTCfcAfuUfuGfgGfuAfgUfaUfuCfudTsdT | 437 | 52 |
| AM01292-AS | dTCfaCfcAfuUfuGfgGfuAfgUfaUfudTsdT | 438 | 53 |
| AM01293-AS | dTCfcAfcCfaUfuUfgGfgUfaGfuAfudTsdT | 439 | 54 |
| AM01294-AS | dTAfuAfaCfaCfcAfaGfgGfcGfaAfudTsdT | 440 | 55 |
| AM01295-AS | dTAfcUfgGfgAfuCfcAfuGfgUfaUfadTsdT | 441 | 56 |
| AM01296-AS | dTCfaCfuGfgGfaUfcCfaUfgGfuAfudTsdT | 442 | 57 |
| AM01297-AS | dTAfcCfaCfcGfuGfgGfaGfuUfgUfgdTsdT | 443 | 58 |
| AM01298-AS | dTCfaAfgAfcUfgAfcAfuGfuUfcUfudTsdT | 444 | 59 |
| AM01299-AS | dTGfgGfaGfuUfgUfgAfgGfaCfaCfudTsdT | 445 | 60 |
| AM01300-AS | dTUfcUfcAfgGfuGfgUfgCfuUfgUfudTsdT | 446 | 61 |
| AM01301-AS | dTCfaCfaGfgCfUfuUfuCfuCfaGfgdTsdT | 447 | 62 |
| AM01302-AS | dTGfaUfgCfcAfgUfgUfgGfuAfuCfadTsdT | 448 | 63 |
| AM01303-AS | dTUfgAfuGfcCfaGfuGfuGfgUfaUfcdTsdT | 449 | 64 |
| AM01304-AS | dTGfaCfaCfcUfgAfuUfcUfgUfuUfcdTsdT | 450 | 65 |
| AM01305-AS | dTGfgAfcAfcCfuGfaUfcUfgUfuUfudTsdT | 451 | 66 |
| AM01306-AS | dTCfuAfgGfaCfaCfcUfgAfuUfcUfgdTsdT | 452 | 67 |
| AM01796-AS | dTAfuAfaGfgGfcUfgCfcAfcAfgGfgdTsdT | 453 | 68 |
| AM01798-AS | dTAfaCfaAfuAfaGfgGfcUfgCfcAfdTsdT | 454 | 69 |
| AM01800-AS | dTGfuCfcGfaCfuAfuGfcUfgGfuGfudTsdT | 455 | 70 |
| AM01802-AS | dTUfcUfcAfgCfaUfcUfgGfaUfuCfcdTsdT | 456 | 71 |
| AM01804-AS | dTCfgAfaUfcUfcAfgCfaUfcUfgGfadTsdT | 457 | 72 |
| AM01806-AS | dTAfaGfgGfcGfaAfuCfuCfaGfcAfudTsdT | 458 | 73 |
| AM01808-AS | dTUfgAfcAfcUfgGfgAfuCfcAfuGfgdTsdT | 459 | 74 |
| AM01810-AS | dTCfcGfuUfgGfuGfcUfuCfuUfcAfgdTsdT | 460 | 75 |
| AM01812-AS | dTCfuUfgAfuUfcUfgUfcAfcUfgGfadTsdT | 461 | 76 |
| AM01814-AS | dTCfaCfcGfuGfgGfaGfuUfgUfgAfgdTsdT | 462 | 77 |
| AM01816-AS | dTUfcUfaGfgAfcAfcCfuGfaUfcUfudTsdT | 463 | 78 |
| AM01818-AS | dTAfgUfcUfcUfaGfgAfcAfcCfuGfadTsdT | 464 | 79 |
| AM02003-AS | dTGfuAfuAfaCfaAfuaaGfgGfgCfudTsdT | 465 | 5 |
| AM02004-AS | dTGfuAfuA$_{UNA}$aCfaAfuaaGfgGfgCfudTsdT | 466 | 5 |
| AM02005-AS | dTGfuAfuAfA$_{UNA}$CfaAfuaaGfgGfgCfudTsdT | 467 | 5 |
| AM02007-AS | dTCfgUfaUfaAfcAfauaAfgGfgGfcdTsdT | 468 | 6 |
| AM02008-AS | dTCfgUfaU$_{UNA}$aAfcAfauaAfgGfgGfcdTsdT | 469 | 6 |
| AM02009-AS | dTCfgUfaUfA$_{UNA}$AfcAfauaAfgGfgGfcdTsdT | 470 | 6 |
| AM02011-AS | dTGfcGfuCfuGfaGfcauUfgUfgUfcdTsdT | 471 | 8 |
| AM02012-AS | dTGfcGfuC$_{UNA}$uGfaGfcauUfgUfgUfcdTsdT | 472 | 8 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM02013-AS | dTGfcGfuCfU$_{UNA}$GfaGfcauUfgUfgUfcdTsdT | 473 | 8 |
| AM02015-AS | dTUfgCfgUfcUfgAfgcaUfuGfuGfudTsdT | 474 | 9 |
| AM02016-AS | dTUfgCfgU$_{UNA}$cUfgAfgcaUfuGfuGfudTsdT | 475 | 9 |
| AM02017-AS | dTUfgCfgUfC$_{UNA}$UfgAfgcaUfuGfuGfudTsdT | 476 | 9 |
| AM02019-AS | dTGfaGfaAfuGfaGfccuCfgAfuAfadTsdT | 477 | 51 |
| AM02020-AS | dTGfaGfaA$_{UNA}$uGfaGfccuCfgAfuAfadTsdT | 478 | 51 |
| AM02021-AS | dTGfaGfaAfU$_{UNA}$GfaGfccuCfgAfuAfadTsdT | 479 | 51 |
| AM02023-AS | dTGfaCfaCfcUfgAfuucUfgUfuUfcdTsdT | 480 | 65 |
| AM02024-AS | dTGfaCfaC$_{UNA}$cUfgAfuucUfgUfuUfcdTsdT | 481 | 65 |
| AM02025-AS | dTGfaCfaCfcC$_{UNA}$UfgAfuucUfgUfuUfcdTsdT | 482 | 65 |
| AM02027-AS | dTGfuCfcGfaCfuAfugcUfgGfuGfudTsdT | 483 | 70 |
| AM02028-AS | dTGfuCfcG$_{UNA}$aCfuAfugcUfgGfuGfudTsdT | 484 | 70 |
| AM02029-AS | dTGfuCfcGfA$_{UNA}$CfuAfugcUfgGfuGfudTsdT | 485 | 70 |
| AM02031-AS | dTCfgAfaUfcUfcAfgcaUfcUfgGfadTsdT | 486 | 72 |
| AM02032-AS | dTCfgAfaU$_{UNA}$cUfcAfgcaUfcUfgGfadTsdT | 487 | 72 |
| AM02033-AS | dTCfgAfaUfC$_{UNA}$UfcAfgcaUfcUfgGfadTsdT | 488 | 72 |
| AM02035-AS | dTAfaGfgGfcGfaAfucuCfaGfcAfudTsdT | 489 | 73 |
| AM02036-AS | dTAfaGfgG$_{UNA}$cGfaAfucuCfaGfcAfudTsdT | 490 | 73 |
| AM02037-AS | dTAfaGfgGfC$_{UNA}$GfaAfucuCfaGfcAfudTsdT | 491 | 73 |
| AM02039-AS | dTUfgAfcAfcUfgGfauCfcAfuGfgdTsdT | 492 | 74 |
| AM02040-AS | dTUfgAfcA$_{UNA}$cUfgGfgauCfcAfuGfgdTsdT | 493 | 74 |
| AM02041-AS | dTUfgAfcAfcC$_{UNA}$UfgGfgauCfcAfuGfgdTsdT | 494 | 74 |
| AM02240-AS | dTCfaAfuAfaGfgGfgcuGfcCfaCfadTsdT | 495 | 80 |
| AM02241-AS | dTCfuGfcGfuCfuGfagcAfuUfgUfgdTsdT | 496 | 81 |
| AM02242-AS | dTAfcAfgGfaUfcUfggaUfuUfcGfgdTsdT | 497 | 82 |
| AM02243-AS | dTCfcGfgGfgGfuUfccUfcAfgUfcdTsdT | 498 | 83 |
| AM02244-AS | dTUfgUfcCfaUfaAfuggUfaGfuAfgdTsdT | 499 | 84 |
| AM02245-AS | dTUfcUfgUfcCfaUfaauGfuGfaGfudTsdT | 500 | 85 |
| AM02246-AS | dTAfcUfcUfgUfcCfauaAfuGfgUfadTsdT | 501 | 86 |
| AM02247-AS | dTAfaCfuCfuGfuCfcauAfuGfgUfudTsdT | 502 | 87 |
| AM02248-AS | dTGfgGfcGfaAfuCfucaGfcAfuCfudTsdT | 503 | 88 |
| AM02249-AS | dTAfgGfgCfgAfaUfcucAfgCfaUfcdTsdT | 504 | 89 |
| AM02250-AS | dTAfaCfaCfcAfaGfggcGfaAfuCfudTsdT | 505 | 90 |
| AM02251-AS | dTAfgGfaCfaCfuUfgauUfcUfgUfcdTsdT | 506 | 91 |
| AM02252-AS | dTGfgAfcCfaAfgAfcugAfcAfuGfudTsdT | 507 | 92 |
| AM02253-AS | dTGfgUfcAfgGfcCfaccAfuUfuGfgdTsdT | 508 | 93 |
| AM02254-AS | dTAfuCfcAfuGfgUfauaAfcAfcCfadTsdT | 509 | 94 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM02255-AS | dTGfgGfaUfcCfaUfgguAfuAfaCfadTsdT | 510 | 95 |
| AM02256-AS | dTUfgGfaCfaUfuGfuguCfaGfgUfudTsdT | 511 | 96 |
| AM02257-AS | dTAfuUfcUfgUfcAfcugGfaCfaUfudTsdT | 512 | 97 |
| AM02258-AS | dTGfgUfgCfuUfgUfucaGfaAfaCfadTsdT | 513 | 98 |
| AM02259-AS | dTGfgAfgAfaUfgAfgccUfcGfaUfadTsdT | 514 | 99 |
| AM02260-AS | dTGfuGfgAfgAfaUfgagCfcUfcGfadTsdT | 515 | 100 |
| AM02261-AS | dTCfcGfuGfgGfaGfuugUfgAfgGfadTsdT | 516 | 101 |
| AM02262-AS | dTGfgAfcCfaCfcGfuggGfaGfuUfgdTsdT | 517 | 102 |
| AM02263-AS | dTUfgCfuUfgUfuCfagaAfgGfaGfcdTsdT | 518 | 103 |
| AM02264-AS | dTCfuGfaUfgCfcAfgugUfgGfuAfudTsdT | 519 | 104 |
| AM02265-AS | dTUfaGfgAfcAfcCfugaUfuCfuGfudTsdT | 520 | 105 |
| AM02266-AS | dTCfuCfuAfgGfaCfaccUfgAfuUfcdTsdT | 521 | 106 |
| AM02267-AS | dTUfcUfcUfaGfgAfcacCfuGfaUfudTsdT | 522 | 107 |
| AM02268-AS | dTGfuCfuCfuAfgGfacaCffcUfgAfudTsdT | 523 | 108 |
| AM02404-AS | dTsGfsaGfaAfuGfaGfcCfuCfgAfuAfaCfuCfsusuAu | 524 | 109 |
| AM02406-AS | dTsGfsaGfaAfuGfaGfccUfCfgAfuAfaCfuCfsusuAu | 525 | 109 |
| AM02408-AS | dTsGfsaGfaAfuGfaGfccUfcgAfuAfaCfuCfsusuAu | 526 | 109 |
| AM02410-AS | dTsGfsaGfaAfuGfaGfcCfUfcGfaUfaAfcUfcsUfsuAu | 527 | 109 |
| AM02412-AS | dTsGfsaCfaCfcUfgAfuUfcUfgUfuUfcUfgAfsgsuAu | 528 | 110 |
| AM02414-AS | dTsGfsaCfaCfcUfgAfuuCfUfgUfuUfcUfgAfsgsuAu | 529 | 110 |
| AM02416-AS | dTsGfsaCfaCfcUfgAfuuCfugUfuUfcUfgAfsgsuAu | 530 | 110 |
| AM02418-AS | dTsGfsaCfaCfcUfgAfuUfCfuGfuUfuCfuGfasGfsuAu | 531 | 110 |
| AM02531-AS | dTsCfsgUfaUfaAfcAfauaAfgGfgGfcUfgCfscsuAu | 532 | 111 |
| AM02532-AS | dTsGfscGfuCfuGfaGfcauUfgUfgUfcAfgGfsusuAu | 533 | 112 |
| AM02533-AS | dTsUfsgCfgUfcUfgAfgcaUfuGfuGfuCfaGfsgsuAu | 534 | 113 |
| AM02534-AS 1532-AS00 | dTsGfsaGfaAfuGfaGfccuCfgAfuAfaCfuCfsusuAu | 535 | 109 |
| AM02535-AS 1533-AS00 | dTsGfsaCfaCfcUfgAfuucUfgUfuUfcUfgAfsgsuAu | 536 | 110 |
| AM02536-AS | dTsAfsaGfgGfcGfaAfucuCfaGfcAfuCfuGfsgsuAu | 537 | 114 |
| AM02755-AS | usUfsaAfcAfaUfaAfgGfgGfcUfgCfAbs(PAZ) | 538 | 115 |
| AM02756-AS | usGfsuAfuAfaCfaAfuAfaGfgGfcCfAbs(PAZ) | 539 | 116 |
| AM02757-AS | usCfsgUfaUfaAfcAfaUfaAfgGfgGfAbs(PAZ) | 540 | 117 |
| AM02758-AS | usGfscGfuCfuGfaGfcAfuUfgUfgUfAbs(PAZ) | 541 | 118 |
| AM02759-AS | usUfsgCfgUfcUfgAfgCfaUfuGfuGfAbs(PAZ) | 542 | 119 |
| AM02760-AS | usCfsaGfgAfuCfuGfgAfuUfuCfgGfAbs(PAZ) | 543 | 120 |
| AM02761-AS | usUfsgCfaUfcUfgAfgCfaUfcGfuGfAbs(PAZ) | 544 | 121 |
| AM02762-AS | usCfsgAfcUfaUfgCfuGfuGfuGfGfAbs(PAZ) | 545 | 122 |
| AM02763-AS | usUfsuUfcUfgGfgGfuCfcGfaCfuAfAbs(PAZ) | 546 | 123 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM02764-AS | usGfscGfaAfuCfuCfaGfcAfuCfuGfAbs(PAZ) | 547 | 124 |
| AM02765-AS | usUfsgCfaAfgGfaCfaCfuUfgAfuUfAbs(PAZ) | 548 | 125 |
| AM02766-AS | usAfsaUfgAfgCfcUfcGfaUfaAfcUfAbs(PAZ) | 549 | 126 |
| AM02767-AS | usGfsaAfuGfaGfcCfuCfgAfuAfaCfAbs(PAZ) | 550 | 127 |
| AM02768-AS | usGfsaCfaUfuGfuGfuCfaGfgUfuGfAbs(PAZ) | 551 | 128 |
| AM02769-AS | usGfsaGfaAfuGfaGfcCfuCfgAfuAfAbs(PAZ) | 552 | 129 |
| AM02770-AS | usCfscAfuUfuGfgGfuAfgUfaUfuCfAbs(PAZ) | 553 | 130 |
| AM02771-AS | usCfsaCfcAfuUfuGfgGfuAfgUfaUfAbs(PAZ) | 554 | 131 |
| AM02772-AS | usGfsaCfaCfcUfgAfuUfcUfgUfuUfAbs(PAZ) | 555 | 132 |
| AM02773-AS | usGfsgAfcAfcCfuGfaUfuCfuGfuUfAbs(PAZ) | 556 | 133 |
| AM02774-AS | usUfsaAfcAfaUfaAfgGfgGfcUfgAbAbs(PAZ) | 557 | 134 |
| AM02775-AS | usGfsuAfuAfcAfaUfaAfgGfgGfaAbAbs(PAZ) | 558 | 135 |
| AM02776-AS | usCfsgUfaUfaAfcAfaUfaAfgGfgAbAbs(PAZ) | 559 | 136 |
| AM02777-AS | usGfscGfuCfuGfaGfcAfuUfgUfgAbAbs(PAZ) | 560 | 137 |
| AM02778-AS | usUfsgCfgUfcUfgAfgCfaUfuGfuAbAbs(PAZ) | 561 | 138 |
| AM02779-AS | usCfsaGfgAfuCfuGfgAfuUfuCfgAbAbs(PAZ) | 562 | 139 |
| AM02780-AS | usUfsgCfaUfcUfgAfgCfaUfcGfuAbAbs(PAZ) | 563 | 140 |
| AM02781-AS | usCfsgAfcUfaUfgCfuGfgUfgUfgAbAbs(PAZ) | 564 | 141 |
| AM02782-AS | usUfsuUfcUfgGfgGfuCfcGfaCfuAbAbs(PAZ) | 565 | 142 |
| AM02783-AS | usGfscGfaAfuCfuCfaGfcAfuCfuAbAbs(PAZ) | 566 | 143 |
| AM02784-AS | usUfsgCfaAfgGfaCfaCfuUfgAfuAbAbs(PAZ) | 567 | 144 |
| AM02785-AS | usAfsaUfgAfgCfcUfcGfaUfaAfcAbAbs(PAZ) | 568 | 145 |
| AM02786-AS | usGfsaAfuGfaGfcCfuCfgAfuAfaAbAbs(PAZ) | 569 | 146 |
| AM02787-AS | usGfsaCfaUfuGfuGfuCfaGfgUfuAbAbs(PAZ) | 570 | 147 |
| AM02788-AS | usGfsaGfaAfuGfaGfcCfuCfgAfuAbAbs(PAZ) | 571 | 148 |
| AM02789-AS | usCfscAfuUfuGfgGfuAfgUfaUfuAbs(PAZ) | 572 | 149 |
| AM02790-AS | usCfsaCfcAfuUfuGfgGfuAfgUfaAbAbs(PAZ) | 573 | 150 |
| AM02791-AS | usGfsaCfaCfcUfgAfuUfcUfgUfuAbAbs(PAZ) | 574 | 151 |
| AM02792-AS | usGfsgAfcAfcCfuGfaUfuCfuGfuAbAbs(PAZ) | 575 | 152 |
| AM02857-AS 1532-AS14 | usGfsaGfaAfuGfaGfccuCfgAfuAfaCfuCfsusuAu | 576 | 153 |
| AM02858-AS | usgsaGfaAfuGfaGfccuCfgAfuAfaCfuCfsusuAu | 577 | 153 |
| AM02859-AS | usgsaGfaAfuGfaGfccuCfgAfuAfaCfucsusuAu | 578 | 153 |
| AM02860-AS | usGfsaGfaAfuGfaGfccuCfgAfuAfaCfucsusuAu | 579 | 153 |
| AM02863-AS 1533-AS15 | usGfsaCfaCfcUfgAfuucUfgUfuUfcUfgAfsgsuAu | 580 | 154 |
| AM02864-AS | usgsaCfaCfcUfgAfuucUfgUfuUfcUfgAfsgsuAu | 581 | 154 |
| AM02865-AS | usgsaCfaCfcUfgAfuucUfgUfuUfcUfgasgsuAu | 582 | 154 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM02866-AS | usGfsaCfaCfcUfgAfuucUfgUfuUfcUfgasgsuAu | 583 | 154 |
| AM02943-AS | usgsagaAfugaGfccuCfgAfuaaCfuCfsusuAu | 584 | 153 |
| AM02944-AS | usgsagaauGfagccuCfgauAfaCfuCfsusuAu | 585 | 153 |
| AM02945-AS | usgsagaauGfagccuCfgauAfacucsusuAu | 586 | 153 |
| AM02950-AS | usgsaCfaCfcUfgAfuucUfgUfuucUfgasgsuAu | 587 | 154 |
| AM02951-AS | usgsaCfaCfcUfgAfuucUfguuUfcugasgsuAu | 588 | 154 |
| AM02952-AS | usgsacaccugAfuucUfgUfuucUfgasgsuAu | 589 | 154 |
| AM03040-AS | usGfsAfcAfcCfUfgAfuucUfgUfuUfcUfgAfsgsuAu | 590 | 154 |
| AM03041-AS | usGfsAfcAfccUfgAfuucUfgUfuUfcUfgAfsgsuAu | 591 | 154 |
| AM03043-AS | usGfsaCfaCfCfUfgAfuucUfgUfuUfcUfgAfsgsuAu | 592 | 154 |
| AM03065-AS 1533-AS18 | dTsGfsaCfaCfcugauucUfgUfuUfcUfgAfsgsuAu | 593 | 110 |
| AM03066-AS 1533-AS03 | usGfsaCfaCfcugauucUfgUfuUfcUfgAfsgsuAu | 594 | 154 |
| AM03067-AS | dTsGfsaCfaCfcugauucUfgUfuucugasgsuAu | 595 | 110 |
| AM03068-AS | usGfsaCfaCfcugauucUfgUfuucugasgsuAu | 596 | 154 |
| AM03069-AS 1533-AS14 | dTsGfsaCfaCfcUfgAfuucUfgUfuucugasgsuAu | 597 | 110 |
| AM03070-AS 1533-AS29 | usGfsaCfaCfcUfgAfuucUfgUfuucugasgsuAu | 598 | 154 |
| AM03107-AS | usCfsgUfaUfaAfcAfauaAfgGfgGfcUfgCfscsuAu | 599 | 156 |
| AM03108-AS | usCfsgUfaUfaAfcAfauaAfgGfgGfcUfgcscsuAu | 600 | 156 |
| AM03119-AS | usGfsaGfaAfuGfaGfccuCfgAfuAfaCfuCfuCMsTMsuAu | 601 | 155 |
| AM03120-AS | usGfsaGfaAfuGfaGfccuCfgAfuAfaCfuCfuCMTMuAu | 602 | 155 |
| AM03121-AS | usGfsaGfaAfuGfaGfccuCfgAfuAfaCfucuuAu | 603 | 153 |
| AM03127-AS | usCfsgUfaUfaAfCfAfauaAfgGfgGfcUfgCfscsuAu | 604 | 156 |
| AM03129-AS | usCfsgUfaUfaAfCfAfauaAfgGfgGfcUfgcscsuAu | 605 | 156 |
| AM03130-AS | usGfsaGfaAfuGfaGfCfcuCfgAfuAfaCfuCfsusuAu | 606 | 153 |
| AM03131-AS | usGfsaGfaAfuGfaGfCfCfuCfgAfuAfaCfuCfsusuAu | 607 | 153 |
| AM03149-AS | usGfsagaAfugaGfccuCfgAfuaaCfuCfsusuAu | 608 | 153 |
| AM03150-AS | usGfsagaauGfagccuCfgauAfaCfuCfsusuAu | 609 | 153 |
| AM03151-AS | usGfsagaauGfagccuCfgauAfacucsusuAu | 610 | 153 |
| AM03255-AS 1532-AS26 | usGfsaGfaAfugaGfccuCfgauaaCfuCfsusuAu | 611 | 153 |
| AM03256-AS | usGfsagaaugagccuCfgauaaCfuCfsusuAu | 612 | 153 |
| AM03257-AS | usGfsagaaugagccuCfgauaacuCfsusuAu | 613 | 153 |
| AM03258-AS | usGfsagaaugagccuCfgauaaCfucsusuAu | 614 | 153 |
| AM03259-AS | usGfsagaaugagccuCfgauaacucsusuAu | 615 | 153 |
| AM03260-AS | usGfsaGfaAfugaGfccUfCfgauaaCfuCfsusuAu | 616 | 153 |
| AM03261-AS | usGfsagaaugagccUfCfgauaaCfuCfsusuAu | 617 | 153 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM03262-AS | usGfsagaaugagccUfCfgauaacuCfsusuAu | 618 | 153 |
| AM03263-AS | usGfsagaaugagccUfCfgauaaCfucsusuAu | 619 | 153 |
| AM03264-AS | usGfsagaaugagccUfCfgauaacucsusuAu | 620 | 153 |
| AM03265-AS | usGfsaGfaAfugaGfcCfuCfgauaaCfuCfsusuAu | 621 | 153 |
| AM03266-AS | usGfsagaaugagcCfuCfgauaaCfuCfsusuAu | 622 | 153 |
| AM03267-AS | usGfsagaaugagcCfuCfgauaacuCfsusuAu | 623 | 153 |
| AM03268-AS | usGfsagaaugagcCfuCfgauaaCfucsusuAu | 624 | 153 |
| AM03269-AS | usGfsagaaugagcCfuCfgauaacucsusuAu | 625 | 153 |
| AM03270-AS | usGfsaGfaAfugaGfCfcuCfgauaaCfuCfsusuAu | 626 | 153 |
| AM03271-AS | usGfsagaaugagCfcuCfgauaaCfuCfsusuAu | 627 | 153 |
| AM03272-AS | usGfsagaaugagCfcuCfgauaacuCfsusuAu | 628 | 153 |
| AM03273-AS | usGfsagaaugagCfcuCfgauaaCfucsusuAu | 629 | 153 |
| AM03274-AS | usGfsagaaugagCfcuCfgauaacucsusuAu | 630 | 153 |
| AM03279-AS | usCfsgUfaUfaacaauaAfgGfgGfcUfgCfscsuAu | 631 | 156 |
| AM03280-AS | usCfsgUfaUfaAfcAfauaAfggggcUfgCfscsuAu | 632 | 156 |
| AM03281-AS | usCfsguauaAfcAfauaAfgGfgGfcUfgCfscsuAu | 633 | 156 |
| AM03282-AS | usCfsgUfaUfaAfcAfauaAfgGfgGfcugcscsuAu | 634 | 156 |
| AM03283-AS | usCfsgUfaUfaacaauaAfgGfgGfcugcscsuAu | 635 | 156 |
| AM03284-AS | usCfsguauaAfcAfauaAfggggcUfgCfscsuAu | 636 | 156 |
| AM03300-AS | usCfsgUfaUfaacaaUfaAfgGfgGfcUfgCfscsuAu | 637 | 156 |
| AM03301-AS | usCfsguauaAfcAfaUfaAfggggcUfgCfscsuAu | 638 | 156 |
| AM03331-AS | usGfsaGfaAfuGfaGfcCfuCfgAfuAfasdTsdT | 639 | 157 |
| AM03375-AS | usCfsguauaAfcAfauaAfggggcugcscsuAu | 640 | 156 |
| AM03376-AS | usCfsguauaacaauaAfggggcugcscsuAu | 641 | 156 |
| AM03377-AS | usGfsagaauGfaGfccuCfgauaacucsusuAu | 642 | 153 |
| AM03427-AS | dTsGfaGfaAfuGfaGfccuCfgAfuAfaCfuCfuuAu | 643 | 109 |
| AM03486-AS | vpdTGfsaGfaAfuGfaGfccuCfgAfuAfaCfucsusuAu | 644 | 109 |
| AM03487-AS | vpdTsGfsaGfaAfuGfaGfccuCfgAfuAfaCfucsusuAu | 645 | 109 |
| AM03488-AS | dTsGfsaGfaAfuGfaGfccuCfgAfuAfaCfucsusuAu | 646 | 109 |
| AM03490-AS | vpdTCfsgUfaUfaAfcAfauaAfgGfgGfcUfgCfscsuAu | 647 | 111 |
| AM03491-AS | vpdTsCfsgUfaUfaAfcAfauaAfgGfgGfcUfgCfscsuAu | 648 | 111 |
| AM03655-AS | usGfsAfgaaugagccuCfgauaacucsusuAu | 649 | 153 |
| AM03656-AS | usGfsaGfaaugagccuCfgauaacucsusuAu | 650 | 153 |
| AM03657-AS | usGfsagAfaugagccuCfgauaacucsusuAu | 651 | 153 |
| AM03658-AS | usGfsagaAfugagccuCfgauaacucsusuAu | 652 | 153 |
| AM03659-AS | usGfsagaaUfgagccuCfgauaacucsusuAu | 653 | 153 |
| AM03660-AS | usGfsagaauGfagccuCfgauaacucsusuAu | 654 | 153 |
| AM03661-AS | usGfsagaaugaGfccuCfgauaacucsusuAu | 655 | 153 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM03671-AS | usCfsgUfaUfaAfcAfauaAfgGfcGfcUfgCfscsuAu | 656 | 158 |
| AM03672-AS | usCfsgUfaUfaAfcAfauaAfggggCfugCfscsuAu | 657 | 156 |
| AM03673-AS | usCfsgUfaUfaAfcAfauaAfggggcugcscsuAu | 658 | 156 |
| AM03674-AS | usCfsGfuauaAfcAfauaAfggggcugcscsuAu | 659 | 156 |
| AM03675-AS | usCfsgUfaUfaAfcaauaAfggggcugcscsuAu | 660 | 156 |
| AM03676-AS | usCfsgUfaUfaaCfaauaAfggggcugcscsuAu | 661 | 156 |
| AM03677-AS | usCfsGfuauAfaCfaauaAfggggcugcscsuAu | 662 | 156 |
| AM03678-AS | usGfsaGfaAfuGfaGfccuCfgauaacucsusuAu | 663 | 153 |
| AM03679-AS | usGfsAfgaAfuGfaGfccuCfgauaacucsusuAu | 664 | 153 |
| AM03680-AS | usGfsAfgAfauGfaGfccCfuCfgauaacucsusuAu | 665 | 153 |
| AM03681-AS | usGfsAfgAfauGfagCfCfuCfgauaacucsusuAu | 666 | 153 |
| AM03682-AS | usGfsaGfaAfuGfagccuCfgauaacucsusuAu | 667 | 153 |
| AM03744-AS | usGfsuauaaCfaAfuaaGfgggAbAbs(PAZ) | 668 | 135 |
| AM03745-AS | usGfsuAfuAfaCfaAfuAfaGfgGMGMAbAbs(PAZ) | 669 | 135 |
| AM03749-AS | usCfsguauaAfcAfauaAfgggAbAbs(PAZ) | 670 | 136 |
| AM03750-AS | usCfsgUfaUfaAfcAfaUfaAfgGMGMAbAbs(PAZ) | 671 | 136 |
| AM03754-AS | usGfsagaauGfaGfccuCfgauAbAbs(PAZ) | 672 | 148 |
| AM03755-AS | usGfsagaaugagcCfuCfgauAbAbs(PAZ) | 673 | 148 |
| AM03756-AS | usGfsaGfaAfuGfaGfcCfuCfgAMTMAbAbs(PAZ) | 674 | 159 |
| AM03760-AS | usGfsacaccUfgAfuucUfguuAbAbs(PAZ) | 675 | 151 |
| AM03761-AS | usGfsaCfaCfcugauucUfguuAbAbs(PAZ) | 676 | 151 |
| AM03762-AS | usGfsaCfaCfcUfgAfuUfcUfgTMTMAbAbs(PAZ) | 677 | 160 |
| AM03823-AS | usCfANAsgUfaUfaAfCfAfauaAfgGfgGfcUfgcscsuAu | 678 | 156 |
| AM03824-AS | usCfsgUfANAaUfaAfCfAfauaAfgGfgGfcUfgcscsuAu | 679 | 156 |
| AM03825-AS | usCfsgUfaUfANAaAfCfAfauaAfgGfgGfcUfgcscsuAu | 680 | 156 |
| AM03826-AS | usCfsgUfaUfaAfANACfAfauaAfgGfgGfcUfgcscsuAu | 681 | 156 |
| AM03827-AS | usGfANAsagaauGfaGfccuCfgauaacucsusuAu | 682 | 153 |
| AM03828-AS | usGfsagaauGfANAaGfccuCfgauaacucsusuAu | 683 | 153 |
| AM03856-AS | TMsGfsagaauGfaGfccuCfgauaacucsusuAu | 684 | 109 |
| AM03857-AS | TMsCfsgUfaUfaAfCfAfauaAfgGfgGfcUfgcscsuAu | 685 | 111 |
| AM03862-AS | TMsGfsagaaugagccuCfgauaacucsusuAu | 686 | 109 |
| AM03866-AS | usCfsgUfaUfaacaauaAfggggcugcscsuAu | 687 | 156 |
| AM03867-AS | usCfsgUfauaAfcaauaAfggggcugcscsuAu | 688 | 156 |
| AM03868-AS | usCfsgUfauaacAfauaAfggggcugcscsuAu | 689 | 156 |
| AM03869-AS | usCfsgUfauaacaaUfaAfggggcugcscsuAu | 690 | 156 |
| AM03870-AS | usCfsguaUfaAfcaauaAfggggcugcscsuAu | 691 | 156 |
| AM03871-AS | usCfsguaUfaacAfauaAfggggcugcscsuAu | 692 | 156 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM03872-AS | usCfsguaUfaacaaUfaAfggggcugcscsuAu | 693 | 156 |
| AM03873-AS | usCfsguauaAfcaaUfaAfggggcugcscsuAu | 694 | 156 |
| AM03874-AS | usCfsguauaacAfaUfaAfggggcugcscsuAu | 695 | 156 |
| AM03875-AS | usCfsgUfaUfaAfcAfaUfaAfgggGfcUfgCfscsuAu | 696 | 156 |
| AM03876-AS | usCfsgUfaUfaAfcAfaUfaAfgGfggcUfgCfscsuAu | 697 | 156 |
| AM03877-AS | usCfsgUfaUfaAfcAfaUfaAfgGfgGfcugCfscsuAu | 698 | 156 |
| AM03878-AS | usCfsgUfaUfaAfcAfaUfaAfgGfgGfcUfgcscsuAu | 699 | 156 |
| AM03883-AS | vpusCfsgsUfaUfaAfCfAfauaAfgGfgGfcUfgasusu | 700 | 161 |
| AM03884-AS | vpusCfsgsUfaUfaAfCfAfauaAfgGfgGfcUfgcsusu | 701 | 162 |
| AM03885-AS | vpusGfsasgaauGfaGfccuCfgauaacucsusu | 702 | 163 |
| AM03929-AS | usCfsguaUfaAfcaauaAfgGfggcugcscsuAu | 703 | 156 |
| AM03930-AS | usCfsguaUfaAfCfaauaAfgGfggcugcscsuAu | 704 | 156 |
| AM03932-AS | usGfsagaAfuGfagccuCfgAfuaacucsusuAu | 705 | 153 |
| AM03933-AS | usGfsagaAfuGfAfgccuCfgAfuaacucsusuAu | 706 | 153 |
| AM03969-AS | vpusCfsgUfaUfaAfCfAfauaAfgGfgGfcUfgcscsuAu | 707 | 156 |
| AM03971-AS | vpusCfsgsUfaUfaAfCfAfauaAfgGfgGfcusu | 708 | 164 |
| AM03972-AS | usCfsgsUfaUfaAfCfAfauaAfgGfgGfcusu | 709 | 164 |
| AM03973-AS | UNNAsCfsgsUfaUfaAfCfAfauaAfgGfgGfcusu | 710 | 164 |
| AM04132-AS | usGfsaGfaAfuGfaGfccuCfgAfuAfaCfucsusuau | 711 | 153 |
| AM04133-AS | usGfsagaauGfaGfccuCfgauaacucsusuau | 712 | 153 |
| AM04134-AS | usGfsaGfaAfuGfAfGfccuCfgAfuAfaCfucsusuau | 713 | 153 |
| AM04135-AS | usGfsagaauGfAfGfccuCfgauaacucsusuau | 714 | 153 |
| AM04136-AS | usGfsaGfaAfuGfAfgccuCfgAfuAfaCfucsusuau | 715 | 153 |
| AM04137-AS | usGfsagaauGfAfgccuCfgauaacucsusuau | 716 | 153 |
| AM04150-AS | usGfsagaauGfaGfccuCfgauaacucsusuau(Dy540) | 717 | 153 |
| AM04215-AS | usCfsgUfaUfaaCfaaUfaAfgGfgGfcUfgCfscsuAu | 718 | 156 |
| AM04216-AS | usCfsguauaAfcaaUfaAfggggcugCfscsuAu | 719 | 156 |
| AM04217-AS | usCfsguauaaCfaaUfaAfggggcugCfscsuAu | 720 | 156 |
| AM04218-AS | usCfsguauaaCfaaUfaAfggggCfugCfscsuAu | 721 | 156 |
| AM04219-AS | usCfsguaUfaaCfaaUfaAfggggCfugCfscsuAu | 722 | 156 |
| AM04250-AS | usGfsuAfuAfaCfaAfuAfaGfgGfGMGMsAbsAbs(PAZ) | 723 | 135 |
| AM04251-AS | usGfsuAfuAfaCfaAfuAfaGfgGMGM(Sp18)s(PAZ) | 724 | 165 |
| AM04252-AS | usGfsuAfuAfaCfaAfuAfaGfgGMGM(C12)s(PAZ) | 725 | 165 |
| AM04253-AS | usCfsgUfaUfaAfcAfaUfaAfgGMGMsAbsAbs(PAZ) | 726 | 136 |
| AM04254-AS | usCfsgUfaUfaAfcAfaUfaAfgGMGM(Sp18)s(PAZ) | 727 | 166 |
| AM04255-AS | usCfsgUfaUfaAfcAfaUfaAfgGMGM(C12)s(PAZ) | 728 | 166 |
| AM04256-AS | usGfsaGfaAfuGfaGfcCfuCfgAMTMsAbsAbs(PAZ) | 729 | 159 |
| AM04257-AS | usGfsaGfaAfuGfaGfcCfuCfgAMTM(Sp18)s(PAZ) | 730 | 167 |

TABLE 2A-continued

LPA RNAi agent antisense strands having modified nucleotides.

| Antisense Strand ID | Antisense strand sequence 5' → 3' | SEQ ID NO. | SEQ ID NO. |
| --- | --- | --- | --- |
| AM04258-AS | usGfsaGfaAfuGfaGfcCfuCfgAMTM(C12)s(PAZ) | 731 | 167 |
| AM04259-AS | usGfsaCfaCfcUfgAfuUfcUfgTMTMsAbsAbs(PAZ) | 732 | 160 |
| AM04260-AS | usGfsaCfaCfcUfgAfuUfcUfgTMTM(Sp18)s(PAZ) | 733 | 168 |
| AM04261-AS | usGfsaCfaCfcUfgAfuUfcUfgTMTM(C12)s(PAZ) | 734 | 168 |
| AM04377-AS | dTusCfsgUfaUfaacaaUfaAfgGfgGfcUfgCfscsua | 735 | 169 |
| AM04378-AS | uAusCfsgUfaUfaacaaUfaAfgGfgGfcUfgCfscsu | 736 | 170 |
| AM04379-AS | dTcsCfsgUfaUfaacaaUfaAfgGfgGfcUfgCfscsua | 737 | 171 |
| AM04380-AS | cUcsCfsgUfaUfaacaaUfaAfgGfgGfcUfgCfscsu | 738 | 172 |
| AM04383-AS | dTusGfsaGfaAfuGfaGfccuCfgAfuAfaCfucsusua | 739 | 173 |
| AM04384-AS | uAusGfsaGfaAfuGfaGfccuCfgAfuAfaCfucsusu | 740 | 174 |
| AM04385-AS | dTgsGfsaGfaAfuGfaGfccuCfgAfuAfaCfucsusua | 741 | 175 |
| AM04386-AS | gUgsGfsaGfaAfuGfaGfccuCfgAfuAfaCfucsusu | 742 | 176 |
| AM04387-AS | dTusGfsagaauGfaGfccuCfgauaacucsusua | 743 | 173 |
| AM04388-AS | uAusGfsagaauGfaGfccuCfgauaacucsusu | 744 | 174 |
| AM04389-AS | dTgsGfsagaauGfaGfccuCfgauaacucsusua | 745 | 175 |
| AM04390-AS | gUgsGfsagaauGfaGfccuCfgauaacucsusu | 746 | 176 |
| AM04413-AS | usCfsgsUfaUfaacaaUfaAfgGfgGfcusu | 747 | 164 |
| AM04415-AS | usGfsasGfaAfuGfaGfccuCfgAfuAfausu | 748 | 177 |
| AM04437-AS | usGfsuAfuAfaCfaAfuAfaGfgGMGMs(C12)s(PAZ) | 749 | 165 |
| AM04438-AS | usCfsgUfaUfaAfcAfaUfaAfgGMGMs(C12)s(PAZ) | 750 | 166 |
| AM04439-AS | usGfsaGfaAfuGfaGfcCfuCfgAMTMs(C12)s(PAZ) | 751 | 167 |
| AM04440-AS | usGfsaCfaCfcUfgAfuUfcUfgTMTMs(C12)s(PAZ) | 752 | 168 |
| AM04501-AS | cPrpTMsCfsgsUfaUfaAfCfAfauaAfgGfgGfcusu | 753 | 178 |
| AM04507-AS | usGfsasGfaAfuGfaGfccuCfgAfuAfausuAUAUA | 754 | 179 |
| AM04539-AS | usCfsgUfaUfaacaaUfaAfgGfgGfcUfgsCfscuAu | 755 | 156 |
| AM04540-AS | usCfsgUfaUfaacaaUfaAfgGfgGfcUfgsCfcuAu | 756 | 156 |
| AM04541-AS | usGfsaGfaAfuGfaGfccuCfgAfuAfaCfuscsuuAu | 757 | 153 |
| AM04542-AS | usGfsaGfaAfuGfaGfccuCfgAfuAfaCfuscuuAu | 758 | 153 |
| AM04544-AS | usCfsgsUfaUfaAfCfAfauaAfgGfgGfcUfgcsusu | 759 | 162 |
| AM04545-AS | usCfsgsUfaUfaAfCfAfauaagGfgGfcusu | 760 | 164 |
| AM04546-AS | usCfsgsUfaUfaAfCfAfaUfaagGfgGfcusu | 761 | 164 |
| AM04582-AS | usCfsgUfaUfaacaaUfaAfgGfgGfcUfgsCfsc | 762 | 180 |
| AM04583-AS | dTusCfsgUfaUfaacaaUfaAfgGfgGfcUfgsCfsc | 763 | 181 |
| AM04584-AS | dTusCfsgUfaUfaacaaUfaAfgGfgGfcUfgscsc | 764 | 181 |
| AM04585-AS | dTusCfsgsUfaUfaacaaUfaAfgGfgGfcUfgscsc | 765 | 181 |
| AM04586-AS | dTusCfsgsUfaUfaacaaUfaAfgGfgGfcUfgcsc | 766 | 181 |
| AM04587-AS | dTusCfsgsUfaUfaacaaUfaAfgGfgGfcusg | 767 | 182 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| AM04609-AS | epTcPrsCfsgsUfaUfaAfCfAfauaAfgGfgGfcusu | 768 | 178 |
| AM04610-AS | epTMsCfsgsUfaUfaAfCfAfauaAfgGfgGfcusu | 769 | 178 |
| AM04677-AS | usGfsaGfaAfuGfaGfccuCfgAfuAfaCfsuscuuAu | 770 | 153 |
| AM04678-AS | usGfsaGfaAfuGfaGfccuCfgAfuAfasCfsucuuAu | 771 | 153 |
| AM04679-AS | usGfsaGfaAfuGfaGfccuCfgAfuAfaCfuasuscGc | 772 | 183 |
| AM04680-AS | usGfsaGfaAfuGfaGfccuCfgAfuAfaCfuasusuCa | 773 | 184 |
| AM04681-AS | usGfsaGfaAfuGfaGfccuCfgAfuAfaCfuascsgAu | 774 | 185 |
| AM04733-AS | us(5Me-Gf)saGfaAfuGfaGfccuCfgAfuAfaCfucsusuAu | 775 | 153 |
| AM04734-AS | usGfsa(5Me-Gf)aAfuGfaGfccuCfgAfuAfaCfucsusuAu | 776 | 153 |
| AM04735-AS | usGfsaGfaAfu(5Me-Gf)aGfccuCfgAfuAfaCfucsusuAu | 777 | 153 |
| AM04736-AS | usGfsaGfaAfuGfa(5Me-Gf)ccuCfgAfuAfaCfucsusuAu | 778 | 153 |
| AM04805-AS | vpusCfsgsUfaUfaAfCfAfauaAfgGfgGfcgsu | 779 | 186 |
| AM04821-AS | usCfsgUfaUfaacaaUfaAfgGfgGfcUfgCfscsu | 780 | 187 |
| AM04822-AS | usCfsgUfaUfaacaaUfaAfgGfgGfcUfgCfsusu | 781 | 162 |
| AM04823-AS | vpusCfsgUfaUfaacaaUfaAfgGfgGfcUfgCfscsu | 782 | 187 |
| AM04824-AS | vpusCfsgUfaUfaacaaUfaAfgGfgGfcUfgCfsusu | 783 | 162 |
| AM04871-AS | usGfsaGfaAfuGfAfgccuCfgAfuAfaCfusCfsuuAu | 784 | 153 |
| AM04872-AS | cPrpusGfsaGfaAfuGfaGfccuCfgAfuAfaCfucsusuAu | 785 | 153 |
| AM04873-AS | cPrpusCfsgUfaUfaacaaUfaAfgGfgGfcUfgCfscsuAu | 786 | 156 |
| AM04874-AS | usCfsgUfaUfaacaaUfaAfgGfgGfcsusu | 787 | 164 |
| AM04875-AS | cPrpusCfsgUfaUfaacaaUfaAfgGfgGfcsusu | 788 | 164 |
| AM04876-AS | usCfsgUfaUfaacaaUfaAfgGfgGfcsusg | 789 | 188 |
| AM04877-AS | usCfsgUfaUfaacaaUfaAfgGfgGfcsUfsg | 790 | 188 |
| AM04878-AS | cPrpusCfsgUfaUfaacaaUfaAfgGfgGfcUfgCfsusu | 791 | 162 |
| AM04879-AS | usGfsaGfaAfuGfaGfcCfuCfgAfuAfaCfucsusuAu | 792 | 153 |
| AM04880-AS | cPrpusGfsaGfaAfuGfaGfcCfuCfgAfuAfaCfucsusuAu | 793 | 153 |
| AM04969-AS | cPrpTMsGfsaGfaAfuGfaGfcCfuCfgAfuAfaCfucsusuAu | 794 | 109 |
| AM04970-AS | cPrpTMsCfsgUfaUfaacaaUfaAfgGfgGfcUfgCfscsuAu | 795 | 111 |
| AM04971-AS | cPrpTMsCfsgUfaUfaacaaUfaAfgGfgGfcsusu | 796 | 178 |
| AM04972-AS | cPrpTMsCfsgUfaUfaacaaUfaAfgGfgGfcUfgCfsusu | 797 | 189 |
| AM04979-AS | usCfsgsUfaUfaAfcAfaUfaAfgGfgGfcusu | 798 | 164 |
| 1532-AS01 | usgsagaaugaGfccuCfgAfuAfaCfuCfsusuAu | 799 | 153 |
| 1532-AS02 | usgsagaauGfagccuCfgAfuAfaCfuCfsusuAu | 800 | 153 |
| 1532-AS03 | usgsagaAfugagccuCfgAfuAfaCfuCfsusuAu | 801 | 153 |
| 1532-AS04 | usgsaGfaaugagccuCfgAfuAfaCfuCfsusuAu | 802 | 153 |
| 1532-AS05 | usGfsagaaugagccuCfgAfuAfaCfuCfsusuAu | 803 | 153 |
| 1532-AS06 | dTsgsagaaugagccuCfgAfuAfaCfuCfsusuAu | 804 | 109 |
| 1532-AS07 | dTsGfsaGfaAfugagccuCfgAfuAfaCfuCfsusuAu | 805 | 109 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| 1532-AS08 | dTsGfsaGfaAfugaGfccuCfgauAfaCfuCfsusuAu | 806 | 109 |
| 1532-AS09 | dTsGfsaGfaAfuGfagccuCfgauAfaCfuCfsusuAu | 807 | 109 |
| 1532-AS10 | dTsGfsaGfaAfugagccuCfgauAfaCfuCfsusuAu | 808 | 109 |
| 1532-AS11 | dTsGfsaGfaAfugagccuCfgAfuaaCfuCfsusuAu | 809 | 109 |
| 1532-AS12 | dTsGfsaGfaAfugaGfccuCfgauaaCfuCfsusuAu | 810 | 109 |
| 1532-AS13 | dTsGfsaGfaAfuGfagccuCfgauaaCfuCfsusuAu | 811 | 109 |
| 1532-AS15 | dTsgsagaaugaGfccuCfgAfuAfaCfuCfsusuAu | 812 | 109 |
| 1532-AS16 | dTsgsagaauGfagccuCfgAfuAfaCfuCfsusuAu | 813 | 109 |
| 1532-AS17 | dTsgsagaAfugagccuCfgAfuAfaCfuCfsusuAu | 814 | 109 |
| 1532-AS18 | dTsgsaGfaaugagccuCfgAfuAfaCfuCfsusuAu | 815 | 109 |
| 1532-AS19 | dTsGfsagaaugagccuCfgAfuAfaCfuCfsusuAu | 816 | 109 |
| 1532-AS20 | usgsagaaugagccuCfgAfuAfaCfuCfsusuAu | 817 | 153 |
| 1532-AS21 | usGfsaGfaAfugagccuCfgAfuAfaCfuCfsusuAu | 818 | 153 |
| 1532-AS22 | usGfsaGfaAfugaGfccuCfgauAfaCfuCfsusuAu | 819 | 153 |
| 1532-AS23 | usGfsaGfaAfuGfagccuCfgauAfaCfuCfsusuAu | 820 | 153 |
| 1532-AS24 | usGfsaGfaAfugagccuCfgauAfaCfuCfsusuAu | 821 | 153 |
| 1532-AS25 | usGfsaGfaAfugagccuCfgAfuaaCfuCfsusuAu | 822 | 153 |
| 1532-AS27 | usGfsaGfaAfuGfagccuCfgauaaCfuCfsusuAu | 823 | 153 |
| 1533-AS01 | usgsaCfaCfcugAfuucUfgUfuUfcUfgAfsgsuAu | 824 | 154 |
| 1533-AS02 | usgsaCfaCfcUfgauucUfgUfuUfcUfgAfsgsuAu | 825 | 154 |
| 1533-AS04 | dTsgsaCfaCfcugauucUfgUfuUfcUfgAfsgsuAu | 826 | 110 |
| 1533-AS05 | dTsGfsaCfaCfcugAfuucUfguuUfcUfgAfsgsuAu | 827 | 110 |
| 1533-AS06 | dTsGfsaCfaCfcUfgauucUfguuUfcUfgAfsgsuAu | 828 | 110 |
| 1533-AS07 | dTsGfsaCfaCfcUfgauucUfgUfuucUfgAfsgsuAu | 829 | 110 |
| 1533-AS08 | dTsGfsaCfaCfcUfgAfuucUfguuucUfgAfsgsuAu | 830 | 110 |
| 1533-AS09 | dTsGfsaCfaCfcUfgAfuucUfguuUfcugAfsgsuAu | 831 | 110 |
| 1533-AS10 | dTsGfsaCfaCfcUfgAfuucUfgUfuucugAfsgsuAu | 832 | 110 |
| 1533-AS11 | dTsGfsaCfaCfcUfgAfuucUfguuucugAfsgsuAu | 833 | 110 |
| 1533-AS12 | dTsGfsaCfaCfcUfgAfuucUfguuucUfgasgsuAu | 834 | 110 |
| 1533-AS13 | dTsGfsaCfaCfcUfgAfuucUfguuUfcugasgsuAu | 835 | 110 |
| 1533-AS16 | dTsgsaCfaCfcugAfuucUfgUfuUfcUfgAfsgsuAu | 836 | 110 |
| 1533-AS17 | dTsgsaCfaCfcUfgauucUfgUfuUfcUfgAfsgsuAu | 837 | 110 |
| 1533-AS19 | usgsaCfaCfcugauucUfgUfuUfcUfgAfsgsuAu | 838 | 154 |
| 1533-AS20 | usGfsaCfaCfcugAfuucUfguuUfcUfgAfsgsuAu | 839 | 154 |
| 1533-AS21 | usGfsaCfaCfcUfgauucUfguuUfcUfgAfsgsuAu | 840 | 154 |
| 1533-AS22 | usGfsaCfaCfcUfgauucUfgUfuucUfgAfsgsuAu | 841 | 154 |
| 1533-AS23 | usGfsaCfaCfcUfgAfuucUfguuucUfgAfsgsuAu | 842 | 154 |

TABLE 2A-continued

LPA RNAi agent antisense strands having modified nucleotides.

| Antisense Strand ID | Antisense strand sequence 5' → 3' | SEQ ID NO. | SEQ ID NO. |
|---|---|---|---|
| 1533-AS24 | usGfsaCfaCfcUfgAfuucUfguuUfcugAfsgsuAu | 843 | 154 |
| 1533-AS25 | usGfsaCfaCfcUfgAfuucUfgUfuucugAfsgsuAu | 844 | 154 |
| 1533-AS26 | usGfsaCfaCfcUfgAfuucUfguuucugAfsgsuAu | 845 | 154 |
| 1533-AS27 | usGfsaCfaCfcUfgAfuucUfguuucUfgasgsuAu | 846 | 154 |
| 1533-AS28 | usGfsaCfaCfcUfgAfuucUfguuUfcugasgsuAu | 847 | 154 |
| 1533-CfinAS | dTsGfsacaccUfgAfuucUfgUfuUfcUfgAfsgsuAu | 848 | 110 |
| AM05490-AS | usGfsasGfaAfuGfaGfcCfuCfgAfuAfausu | 1262 | 177 |
| AM05492-AS | cPrpTMsCfsgsUfaUfaAfCfAfaUfaAfgGfgGfcusu | 1263 | 178 |
| AM05493-AS | cPrpTMsCfsgsUfaUfaAfcAfaUfaAfgGfgGfcusu | 1264 | 178 |
| AM05495-AS | usCfsguauaaCfaaUfaAfgggGfcugCfscsuAu | 1265 | 156 |
| AM05496-AS | usCfsguaUfaaCfaaUfaAfgggGfcugCfscsuAu | 1266 | 156 |
| AM05497-AS | usCfsgUfaUfaacaaUfaAfgGfgGfcsUfsu | 1267 | 164 |
| AM05498-AS | usCfsgsUfaUfaAfCfAfaUfaAfgGfgGfcusu | 1268 | 164 |

TABLE 2B

LPA RNAi agent sense strands having modified nucleotides.

| Sense Strand ID | SS Sequence 5' → 3' | SEQ ID NO. | SEQ ID NO. |
|---|---|---|---|
| AM01173-SS | AfcGfcAfgAfaGfgGfaCfuGfcCfgAf(invdT) | 849 | 190 |
| AM01174-SS | GfgGfgUfgCfaGfgAfgUfgCfuAfcAf(invdT) | 850 | 191 |
| AM01175-SS | CfuGfuGfgCfaGfcCfcCfuUfaUfuAf(invdT) | 851 | 192 |
| AM01176-SS | GfgCfaGfcCfcCfuUfaUfuGfuUfaAf(invdT) | 852 | 193 |
| AM01177-SS | AfgCfcCfcUfuAfuUfgUfuAfuAfcAf(invdT) | 853 | 194 |
| AM01178-SS | GfcCfcCfuUfaUfuGfuUfaUfaCfgAf(invdT) | 854 | 195 |
| AM01179-SS | UfgAfcAfcAfaUfgCfuCfaGfaCfgAf(invdT) | 855 | 196 |
| AM01180-SS | GfaCfaCfaAfuGfcUfcAfgAfcGfcAf(invdT) | 856 | 197 |
| AM01181-SS | AfcAfcAfaUfgCfuCfaGfaCfgCfaAf(invdT) | 857 | 198 |
| AM01182-SS | AfcAfaUfgCfuCfaGfaCfgCfaGfaAf(invdT) | 858 | 199 |
| AM01183-SS | CfuGfcCfgAfaAfuCfcAfgAfuCfcAf(invdT) | 859 | 200 |
| AM01184-SS | GfcCfgAfaAfuCfcAfgAfuCfcUfgAf(invdT) | 860 | 201 |
| AM01185-SS | UfgAfcAfcGfaUfgCfuCfaGfaUfgAf(invdT) | 861 | 202 |
| AM01186-SS | GfaCfaCfgAfuGfcUfcAfgAfuGfcAf(invdT) | 862 | 203 |
| AM01187-SS | AfcAfcGfaUfgCfuCfaGfaUfgCfaAf(invdT) | 863 | 204 |
| AM01188-SS | AfcGfaUfgCfuCfaGfaUfgCfaGfaAf(invdT) | 864 | 205 |
| AM01189-SS | UfcCfaAfgCfcUfaGfaGfgCfuUfuAf(invdT) | 865 | 206 |
| AM01190-SS | AfgGfaAfaCfcCfcCfgGfgGfuAfcAf(invdT) | 866 | 207 |
| AM01191-SS | GfgAfaAfcCfcCfcCfgGfgGfuAfcAfaAf(invdT) | 867 | 208 |
| AM01192-SS | GfaAfaCfcCfcCfcCfgGfgGfuAfcAfgAf(invdT) | 868 | 209 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM01193-SS | UfgCfuAfcUfaCfcAfuUfaUfgGfaAf(invdT) | 869 | 210 |
| AM01194-SS | GfcUfaCfuAfcCfaUfuAfuGfgAfcAf(invdT) | 870 | 211 |
| AM01195-SS | CfuAfcCfaUfuAfuGfgAfcAfgAfgAf(invdT) | 871 | 212 |
| AM01196-SS | AfcCfaCfcCfcAfgCfaUfaGfuCfgAf(invdT) | 872 | 213 |
| AM01197-SS | CfcAfcAfcCfaGfcAfuAfgUfcGfgAf(invdT) | 873 | 214 |
| AM01198-SS | CfaCfaCfcAfgCfaUfaGfuCfgGfaAf(invdT) | 874 | 215 |
| AM01199-SS | CfaCfcAfgCfaUfaGfuCfgGfaCfcAf(invdT) | 875 | 216 |
| AM01200-SS | AfuAfgUfcGfgAfcCfcCfaGfaAfaAf(invdT) | 876 | 217 |
| AM01201-SS | UfaGfuCfgGfaCfcCfcAfgAfaAfaAf(invdT) | 877 | 218 |
| AM01202-SS | CfcAfgAfuGfcUfgAfgAfuUfcGfcAf(invdT) | 878 | 219 |
| AM01203-SS | GfcUfgAfgAfuUfcGfcCfcUfuGfgAf(invdT) | 879 | 220 |
| AM01204-SS | CfuGfaGfaUfuCfgCfcCfuUfgGfuAf(invdT) | 880 | 221 |
| AM01205-SS | UfgAfgAfuUfcGfcCfcUfuGfgUfgAf(invdT) | 881 | 222 |
| AM01206-SS | GfaGfaUfuCfgCfcCfuUfgGfuGfuAf(invdT) | 882 | 223 |
| AM01207-SS | AfuGfaUfcCfcCfaGfuGfuCfaGfgAf(invdT) | 883 | 224 |
| AM01208-SS | GfaAfuCfaAfgUfgUfcCfuUfgCfaAf(invdT) | 884 | 225 |
| AM01209-SS | AfaUfcAfaGfuGfuCfcUfuGfcAfaAf(invdT) | 885 | 226 |
| AM01210-SS | GfaAfgCfaCfcAfaCfgGfaGfcAfaAf(invdT) | 886 | 227 |
| AM01211-SS | GfaGfuUfaUfcGfaGfgCfuCfaUfuAf(invdT) | 887 | 228 |
| AM01212-SS | AfgUfuAfuCfgAfgGfcUfcAfuUfcAf(invdT) | 888 | 229 |
| AM01213-SS | GfaCfaAfcAfgAfaUfaUfuAfuCfcAf(invdT) | 889 | 230 |
| AM01214-SS | CfuUfgGfuGfuUfaUfaCfcAfuGfgAf(invdT) | 890 | 231 |
| AM01215-SS | GfgUfgUfuAfuAfcCfaUfgGfaUfcAf(invdT) | 891 | 232 |
| AM01216-SS | UfaUfaCfcAfuGfgAfuCfcCfaAfuAf(invdT) | 892 | 233 |
| AM01217-SS | AfuAfcCfaUfgGfaUfcCfcAfaUfgAf(invdT) | 893 | 234 |
| AM01218-SS | UfaCfcAfuGfgAfuCfcCfaAfuGfuAf(invdT) | 894 | 235 |
| AM01219-SS | AfcCfaUfgGfaUfcCfcAfaUfgUfcAf(invdT) | 895 | 236 |
| AM01220-SS | GfcAfaCfcUfgAfcAfcAfaUfgUfcAf(invdT) | 896 | 237 |
| AM01221-SS | CfuGfaCfaCfaAfuGfuCfcAfgUfgAf(invdT) | 897 | 238 |
| AM01222-SS | CfcAfgUfgAfcAfgAfaUfcAfaGfuAf(invdT) | 898 | 239 |
| AM01223-SS | UfuAfuCfgAfgGfcUfcAfuUfcUfcAf(invdT) | 899 | 240 |
| AM01224-SS | AfgAfaUfaCfuAfcCfcAfaAfuGfgAf(invdT) | 900 | 241 |
| AM01225-SS | AfaUfaCfuAfcCfcAfaAfuGfgUfgAf(invdT) | 901 | 242 |
| AM01226-SS | AfuAfcUfaCfcCfaAfaUfgGfuGfgAf(invdT) | 902 | 243 |
| AM01227-SS | AfuUfcGfcCfcUfuGfgUfgUfuAfuAf(invdT) | 903 | 244 |
| AM01228-SS | UfaUfaCfcAfuGfgAfuCfcCfaGfuAf(invdT) | 904 | 245 |
| AM01229-SS | AfuAfcCfaUfgGfaUfcCfcAfgUfgAf(invdT) | 905 | 246 |

TABLE 2B-continued

LPA RNAi agent sense strands having modified nucleotides.

| Sense Strand | SS Sequence 5' → 3' | SEQ ID NO. | SEQ ID NO. |
|---|---|---|---|
| AM01230-SS | CfaCfaAfcUfcCfcAfcGfgUfgGfuAf(invdT) | 906 | 247 |
| AM01231-SS | AfaGfaAfcAfuGfuCfaGfuCfuUfgAf(invdT) | 907 | 248 |
| AM01232-SS | AfgUfgUfcCfuCfaCfaAfcUfcCfcAf(invdT) | 908 | 249 |
| AM01233-SS | AfaCfaAfgCfaCfcAfcCfuGfaGfaAf(invdT) | 909 | 250 |
| AM01234-SS | CfcUfgAfgAfaAfaGfcCfcUfgUfgAf(invdT) | 910 | 251 |
| AM01235-SS | UfgAfuAfcCfaCfaCfuGfgCfaUfcAf(invdT) | 911 | 252 |
| AM01236-SS | GfaUfaCfcAfcAfcUfgGfcAfuCfaAf(invdT) | 912 | 253 |
| AM01237-SS | GfaAfaCfaGfaAfuCfaGfuGfuCfaAf(invdT) | 913 | 254 |
| AM01238-SS | AfaAfcAfgAfaUfcAfgGfuGfuCfcAf(invdT) | 914 | 255 |
| AM01239-SS | CfaGfaAfuCfaGfgUfgUfcCfuAfgAf(invdT) | 915 | 256 |
| AM01795-SS | CfcUfgUfgGfcAfgCfcCfcUfuAfuAf(invdT) | 916 | 257 |
| AM01797-SS | UfgGfcAfgCfcCfcUfuAfuUfgUfuAf(invdT) | 917 | 258 |
| AM01799-SS | AfcAfcCfaGfcAfuAfgUfcGfgAfcAf(invdT) | 918 | 259 |
| AM01801-SS | GfgAfaUfcCfaGfaUfgCfuGfaGfaAf(invdT) | 919 | 260 |
| AM01803-SS | UfcCfaGfaUfgCfuGfaGfaUfcGfaAf(invdT) | 920 | 261 |
| AM01805-SS | AfuGfcUfgAfgAfuUfcGfcCfcUfuAf(invdT) | 921 | 262 |
| AM01807-SS | CfcAfuGfgAfuCfcCfaGfuGfuCfaAf(invdT) | 922 | 263 |
| AM01809-SS | CfuGfaAfgAfaGfcAfcCfaAfcGfgAf(invdT) | 923 | 264 |
| AM01811-SS | UfcCfaGfuGfaCfaGfaAfuCfaAfgAf(invdT) | 924 | 265 |
| AM01813-SS | CfuCfaCfaAfcUfcCfcAfcGfgUfgAf(invdT) | 925 | 266 |
| AM01815-SS | AfgAfaUfcAfgGfuGfuCfcUfaGfaAf(invdT) | 926 | 267 |
| AM01817-SS | UfcAfgGfuGfuCfcUfaGfaGfaCfuAf(invdT) | 927 | 268 |
| AM02006-SS | (Chol-TEG)uAuAfgCfcCfcUfUfAfuUfgUfuAfuAfcAf(invdT) | 928 | 269 |
| AM02010-SS | (Chol-TEG)uAuGfcCfcCfuUfAfUfugUfuAfuAfcCfgAf(invdT) | 929 | 270 |
| AM02014-SS | (Chol-TEG)uAuGfaCfaCfaAfUfGfcUfcAfgAfcGfcAf(invdT) | 930 | 271 |
| AM02018-SS | (Chol-TEG)uAuAfcAfcAfaUfGfcUfcAfgAfcGfcAfaAf(invdT) | 931 | 272 |
| AM02022-SS | (Chol-TEG)uAuUfuAfuCfgAfgGfcUfcAfuUfcUfcAf(invdT) | 932 | 273 |
| AM02026-SS | (Chol-TEG)uAuGfaAfaCfaGfAfAfuCfaGfgUfgUfcAf(invdT) | 933 | 274 |
| AM02030-SS | (Chol-TEG)uAuAfcAfcCfaGfCfAfuAfgUfcGfgAfcAf(invdT) | 934 | 275 |
| AM02034-SS | (Chol-TEG)uAuUfcCfaGfaUfGfcUfgAfgAfuUfcGfaAf(invdT) | 935 | 276 |
| AM02038-SS | (Chol-TEG)uAuAfuGfcUfgAfgAfuUfcGfcCfcUfuAf(invdT) | 936 | 277 |
| AM02042-SS | (Chol-TEG)uAuCfcAfuGfgAfUfCfcCfaGfuGfuCfaAf(invdT) | 937 | 278 |
| AM02211-SS | UfgUfgGfcAfGfCfcCfcUfuAfuUfgAf(invdT) | 938 | 279 |
| AM02212-SS | CfaCfaAfuGfCfUfcAfgAfcGfcAfgAf(invdT) | 939 | 280 |
| AM02213-SS | CfcGfaAfaUfCfCfaGfaUfcCfuGfuAf(invdT) | 940 | 281 |
| AM02214-SS | GfaCfuGfaGfGfAfaAfcCfcCfgGfaAf(invdT) | 941 | 282 |
| AM02215-SS | CfuAfcUfaCfCfAfuUfaUfgGfaCfaAf(invdT) | 942 | 283 |
| AM02216-SS | AfcUfaCfcAfUfUfaUfgGfaCfaGfaAf(invdT) | 943 | 284 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM02217-SS | UfaCfcAfuUfAfUfgGfaCfaGfaGfuAf(invdT) | 944 | 285 |
| AM02218-SS | AfcCfaUfuAfUfGfgAfcAfgAfgUfuAf(invdT) | 945 | 286 |
| AM02219-SS | AfgAfuGfcUfGfAfgAfuUfcGfcCfcAf(invdT) | 946 | 287 |
| AM02220-SS | GfaUfgCfuGfAfGfaUfuCfgCfcCfuAf(invdT) | 947 | 288 |
| AM02221-SS | AfgAfuUfcGfCfCfcUfuGfgUfgUfuAf(invdT) | 948 | 289 |
| AM02222-SS | GfaCfaGfaAfUfCfaAfgUfgUfcCfuAf(invdT) | 949 | 290 |
| AM02223-SS | AfcAfuGfuCfAfGfuCfuUfgGfuCfcAf(invdT) | 950 | 291 |
| AM02224-SS | CfcAfaAfuGfGfUfgGfcCfuGfaCfcAf(invdT) | 951 | 292 |
| AM02225-SS | UfgGfuGfuUfAfUfaCfcAfuGfgAfuAf(invdT) | 952 | 293 |
| AM02226-SS | UfgUfuAfuAfCfCfaUfgGfaUfcCfcAf(invdT) | 953 | 294 |
| AM02227-SS | AfaCfcUfgAfCfAfcAfaUfgUfcCfaAf(invdT) | 954 | 295 |
| AM02228-SS | AfaUfgUfcCfAfGfuGfaCfaGfaAfuAf(invdT) | 955 | 296 |
| AM02229-SS | UfgUfuUfcUfGfAfaCfaAfgCfaCfcAf(invdT) | 956 | 297 |
| AM02230-SS | UfaUfcGfaGfGfCfuCfaUfuCfuCfcAf(invdT) | 957 | 298 |
| AM02231-SS | UfcGfaGfgCfUfCfaUfuCfuCfcAfcAf(invdT) | 958 | 299 |
| AM02232-SS | UfcCfuCfaCfAfAfcUfcCfcAfcGfgAf(invdT) | 959 | 300 |
| AM02233-SS | CfaAfcUfcCfAfcGfgUfgGfuCfcAf(invdT) | 960 | 301 |
| AM02234-SS | GfcUfcCfuUfCfUfgAfaCfaAfgCfaAf(invdT) | 961 | 302 |
| AM02235-SS | AfuAfcCfaCfAfCfuGfgCfaUfcAfgAf(invdT) | 962 | 303 |
| AM02236-SS | AfcAfgAfaUfCfAfgGfuGfuCfcUfaAf(invdT) | 963 | 304 |
| AM02237-SS | GfaAfuCfaGfGfUfgUfcCfuAfgAfgAf(invdT) | 964 | 305 |
| AM02238-SS | AfaUfcAfgGfUfGfuCfcUfaGfaGfaAf(invdT) | 965 | 306 |
| AM02239-SS | AfuCfaGfgUfGfUfcCfuAfgAfgAfcAf(invdT) | 966 | 307 |
| AM02441-SS | uAuAusAfsgUfuAfuCfgAfgGfcUfcAfuUfcUfcAf(C6-SS-Alk-Me) | 967 | 308 |
| AM02442-SS | uAuAusAfsgUfuAfuCfgaGfgCfcUfcAfuUfcUfcAf(C6-SS-Alk-Me) | 968 | 308 |
| AM02443-SS | uAuAusAfsgUfuAfuCfGfaGfgCfcUfcAfuUfcUfcAf(C6-SS-Alk-Me) | 969 | 308 |
| AM02444-SS | uAuAusasGfuUfaUfcGfaGfgCfcUfcAfuUfcUfcAf(C6-SS-Alk-Me) | 970 | 308 |
| AM02445-SS | uAuAusCfsaGfaAfaCfaGfaAfuCfaGfgUfgUfcAf(C6-SS-Alk-Me) | 971 | 309 |
| AM02446-SS | uAuAusCfsaGfaAfaCfagAfAfuCfaGfgUfgUfcAf(C6-SS-Alk-Me) | 972 | 309 |
| AM02447-SS | uAuAusCfsaGfaAfaCfAfgAfAfuCfaGfgUfgUfcAf(C6-SS-Alk-Me) | 973 | 309 |
| AM02448-SS | uAuAuscsAfgAfaAfcAfgAfAfuCfaGfgUfgUfcAf(C6-SS-Alk-Me) | 974 | 309 |
| AM02537-SS | uAuAusCfsaGfcCfcCfuUfAfUfuGfuUfaUfaCfgAf(C11-PEG3-NAG3) | 975 | 310 |
| AM02538-SS | uAuAusCfsuGfaCfaCfaAfUfGfcUfcAfgAfcGfcAf(C11-PEG3-NAG3) | 976 | 311 |
| AM02539-SS | uAuAusUfsgAfcAfcAfaUfGfCfuCfaGfaCfgCfaAf(C11-PEG3-NAG3) | 977 | 312 |
| AM02540-SS | uAuAusAfsgUfuAfuCfgAfGfGfcUfcAfuUfcUfcAf(C11-PEG3-NAG3) | 978 | 308 |
| AM02541-SS | uAuAusCfsaGfaAfaCfaGfAfAfuCfaGfgUfgUfcAf(C11-PEG3-NAG3) | 979 | 309 |
| AM02542-SS | uAuAusAfsgAfuGfcUfgAfGfAfuUfcGfcCfcUfuAf(C11-PEG3-NAG3) | 980 | 313 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM02793-SS | gsCfsaGfcCfcCfuUfaUfuGfuUfa(invdA) | 981 | 314 |
| AM02794-SS | gsCfscCfcUfuAfuUfgUfuAfuAfc(invdA) | 982 | 315 |
| AM02795-SS | csCfscCfuUfaUfuGfuUfaUfaCfg(invdA) | 983 | 316 |
| AM02796-SS | asCfsaCfaAfuGfcUfcAfgAfcGfc(invdA) | 984 | 317 |
| AM02797-SS | csAfscAfaUfgCfuCfaGfaCfgCfa(invdA) | 985 | 318 |
| AM02798-SS | csCfsgAfaAfuCfcAfgAfuCfcUfg(invdA) | 986 | 319 |
| AM02799-SS | csAfscGfaUfgCfuCfaGfaUfgCfa(invdA) | 987 | 320 |
| AM02800-SS | csCfsaCfaCfcAfgCfaUfaGfuCfg(invdA) | 988 | 321 |
| AM02801-SS | usAfsgUfcGfgAfcCfcCfaGfaAfa(invdA) | 989 | 322 |
| AM02802-SS | csAfsgAfuGfcUfgAfgAfuUfcGfc(invdA) | 990 | 323 |
| AM02803-SS | asAfsuCfaAfgUfgUfcCfuUfgCfa(invdA) | 991 | 324 |
| AM02804-SS | asGfsuUfaUfcGfaGfgCfuCfaUfu(invdA) | 992 | 325 |
| AM02805-SS | gsUfsuAfuCfgAfgGfcUfcAfuUfc(invdA) | 993 | 326 |
| AM02806-SS | csAfsaCfcUfgAfcAfcAfaUfgUfc(invdA) | 994 | 327 |
| AM02807-SS | usAfsuCfgAfgGfcUfcAfuUfcUfc(invdA) | 995 | 328 |
| AM02808-SS | gsAfsaUfaCfuAfcCfcAfaAfuGfg(invdA) | 996 | 329 |
| AM02809-SS | asUfsaCfuAfcCfcAfaAfuGfgUfg(invdA) | 997 | 330 |
| AM02810-SS | asAfsaCfaGfaAfuCfaGfgUfgUfc(invdA) | 998 | 331 |
| AM02811-SS | asAfscAfgAfaUfcAfgGfuGfuCfc(invdA) | 999 | 332 |
| AM02812-SS | CfsasGfcCfcCfuUfaUfuGfuUfa(invdA) | 1000 | 333 |
| AM02813-SS | CfscsCfcUfuAfuUfgUfuAfuAfc(invdA) | 1001 | 334 |
| AM02814-SS | CfscsCfuUfaUfuGfuUfaUfaCfg(invdA) | 1002 | 335 |
| AM02815-SS | CfsasCfaAfuGfcUfcAfgAfcGfc(invdA) | 1003 | 336 |
| AM02816-SS | AfscsAfaUfgCfuCfaGfaCfgCfa(invdA) | 1004 | 337 |
| AM02817-SS | CfsgsAfaAfuCfcAfgAfuCfcUfg(invdA) | 1005 | 338 |
| AM02818-SS | AfscsGfaUfgCfuCfaGfaUfgCfa(invdA) | 1006 | 339 |
| AM02819-SS | CfsasCfaCfcAfgCfaUfaGfuCfg(invdA) | 1007 | 340 |
| AM02820-SS | AfsgsUfcGfgAfcCfcCfaGfaAfa(invdA) | 1008 | 341 |
| AM02821-SS | AfsgsAfuGfcUfgAfgAfuUfcGfc(invdA) | 1009 | 342 |
| AM02822-SS | AfsusCfaAfgUfgUfcCfuUfgCfa(invdA) | 1010 | 343 |
| AM02823-SS | GfsusUfaUfcGfaGfgCfuCfaUfu(invdA) | 1011 | 344 |
| AM02824-SS | UfsusAfuCfgAfgGfcUfcAfuUfc(invdA) | 1012 | 345 |
| AM02825-SS | AfsasCfcUfgAfcAfcAfaUfgUfc(invdA) | 1013 | 346 |
| AM02826-SS | AfsusCfgAfgGfcUfcAfuUfcUfc(invdA) | 1014 | 347 |
| AM02827-SS | AfsasUfaCfuAfcCfcAfaAfuGfg(invdA) | 1015 | 348 |
| AM02828-SS | UfsasCfuAfcCfcAfaAfuGfgUfg(invdA) | 1016 | 349 |
| AM02829-SS | AfsasCfaGfaAfuCfaGfgUfgUfc(invdA) | 1017 | 350 |
| AM02830-SS | AfscsAfgAfaUfcAfgGfuGfuCfc(invdA) | 1018 | 351 |

TABLE 2B-continued

LPA RNAi agent sense strands having modified nucleotides.

| Sense Strand | SS Sequence 5' → 3' | SEQ ID NO. | SEQ ID NO. |
|---|---|---|---|
| AM02861-SS | uAuAusAfsgUfuauCfgAfGfGfcUfcAfuUfcUfcAf(C11-PEG3-NAG3) | 1019 | 308 |
| AM02941-SS | uAuAusasguuaucgAfgGfcucauucuca(C11-PEG3-NAG3) | 1020 | 308 |
| AM02942-SS | uAuAusasguuaucgaGfcucauucuca(C11-PEG3-NAG3) | 1021 | 308 |
| AM02946-SS | uAuAuscsagaaaCfagAfAfuCfagguguca(C11-PEG3-NAG3) | 1022 | 309 |
| AM02947-SS | uAuAuscsagaaaCfaGfaAfuCfagguguca(C11-PEG3-NAG3) | 1023 | 309 |
| AM02948-SS | uAuAuscsagaaacaGfaAfucagguguca(C11-PEG3-NAG3) | 1024 | 309 |
| AM02949-SS | uAuAuscsagaaacagAfAfucagguguca(C11-PEG3-NAG3) | 1025 | 309 |
| AM03030-SS | (Stearyl)uAuAusCfsaGfaAfaCfaGfAfAfuCfaGfgUfgUfcUfcAf(C11-PEG3-NAG3) | 1026 | 309 |
| AM03036-SS | uAuAusCfsagaAfaCfaGfAfAfuCfaGfgUfgUfcUfcAf(C11-PEG3-NAG3) | 1027 | 309 |
| AM03037-SS | uAuAusCfsagaaaCfaGfAfAfuCfaGfgUfgUfcUfcAf(C11-PEG3-NAG3) | 1028 | 309 |
| AM03038-SS | uAuAusCfsagaaaCfagaAfuCfaggUfgUfcUfcAf(C11-PEG3-NAG3) | 1029 | 309 |
| AM03039-SS | uAuAusCfsaGfaAfaCfaGfAfAfuCfagGfuGfucAf(C11-PEG3-NAG3) | 1030 | 309 |
| AM03042-SS | uAuAusCfsaGfaAfaCfaGfAfAfucagguguca(C11-PEG3-NAG3) | 1031 | 309 |
| AM03060-SS | uAuAusCfsaGfaAfaCfaGfAfAfuCfaggugUfca(C11-PEG3-NAG3) | 1032 | 309 |
| AM03061-SS | uAuAusCfsaGfaAfaCfaGfAfAfuCfagguguca(C11-PEG3-NAG3) | 1033 | 309 |
| AM03062-SS | uAuAusCfsagaaaCfaGfAfAfuCfaggugUfca(C11-PEG3-NAG3) | 1034 | 309 |
| AM03064-SS | uAuAusCfsaGfaAfaCfaGfaAfuCfaGfgugucAf(C11-PEG3-NAG3) | 1035 | 309 |
| AM03122-SS | uAuAusAfsgUfAfuCfgAfGfGfcUfcAfuUfcUfCMAM(C11-PEG3-NAG3) | 1036 | 308 |
| AM03123-SS | uAuAU$_{UNA}$AfsgsUfuAfuCfgAfGfGfcUfcAfuUfcUfcAf(C11-PEG3-NAG3) | 1037 | 308 |
| AM03124-SS | uAuAuAfsgsUfuAfuCfgAfGfGfcUfcAfuUfcUfcAf(C11-PEG3-NAG3) | 1038 | 308 |
| AM03125-SS | uAuAusCfsaGfcCfcCfuUfAfUfuGfuUfaUfaCfga(C11-PEG3-NAG3) | 1039 | 310 |
| AM03126-SS | uAuAuscsaGfcCfcCfuUfAfUfuGfuUfaUfaCfgAf(C11-PEG3-NAG3) | 1040 | 310 |
| AM03128-SS | uAuAuscsaGfcCfcCfuUfAfUfuGfuUfaUfaCfga(C11-PEG3-NAG3) | 1041 | 310 |
| AM03144-SS | uAuAusAfsgUfuAfuCfgAfGfGfcUfcAfuUfcUfcAf(C6-PEG4-NAG3) | 1042 | 308 |
| AM03220-SS 1532-SS01 | uAuAusAfsgUfuAfuCfgAfGfGfcUfcauucuca | 1043 | 308 |
| AM03221-SS | uAuAusAfsgUfuAfuCfgAfGfGfcucauucuca | 1044 | 308 |
| AM03222-SS | uAuAusAfsguuauCfgAfGfGfcUfcauucuca | 1045 | 308 |
| AM03223-SS | uAuAusAfsguuauCfgAfGfGfcucauucuca | 1046 | 308 |
| AM03224-SS | uAuAusasguuauCfgAfGfGfcucauucuca | 1047 | 308 |
| AM03225-SS | uAuAusasguuaucgAfGfGfcucauucuca | 1048 | 308 |
| AM03226-SS | uAuAusAfsgUfuAfuCfgAfGfdGcUfcauucuca | 1049 | 308 |
| AM03227-SS | uAuAusAfsgUfuAfuCfgAfGfdGcucauucuca | 1050 | 308 |
| AM03228-SS | uAuAusAfsguuauCfgAfGfdGcUfcauucuca | 1051 | 308 |
| AM03229-SS | uAuAusAfsguuauCfgAfGfdGcucauucuca | 1052 | 308 |
| AM03230-SS | uAuAusasguuauCfgAfGfdGcucauucuca | 1053 | 308 |
| AM03231-SS | uAuAusasguuaucgAfGfdGcucauucuca | 1054 | 308 |
| AM03232-SS | uAuAusAfsgUfuAfuCfgaGfGfcUfcauucuca | 1055 | 308 |

TABLE 2B-continued

LPA RNAi agent sense strands having modified nucleotides.

| Sense Strand | SS Sequence 5' → 3' ID | SEQ ID NO. | SEQ ID NO. |
| --- | --- | --- | --- |
| AM03233-SS | uAuAusAfsgUfuAfuCfgaGfGfcucauucuca | 1056 | 308 |
| AM03234-SS | uAuAusAfsguuauCfgaGfGfcUfcauucuca | 1057 | 308 |
| AM03235-SS | uAuAusAfsguuauCfgaGfGfcucauucuca | 1058 | 308 |
| AM03236-SS | uAuAusasguuauCfgaGfGfcucauucuca | 1059 | 308 |
| AM03237-SS | uAuAusasguuaucgaGfGfcucauucuca | 1060 | 308 |
| AM03238-SS | uAuAusAfsgUfuAfuCfgAfGfGfcUfcauucuca(C11-PEG3-NAG3) | 1061 | 308 |
| AM03240-SS | uAuAusAfsguuauCfgAfGfGfcUfcauucuca(C11-PEG3-NAG3) | 1062 | 308 |
| AM03330-SS 1532-SS00 | uAuAusAfsgUfuAfuCfgAfGfGfcUfcAfuUfcUfcAf | 1063 | 308 |
| AM03291-SS | uAuAusCfsaGfcCfcCfuUfAfUfuGfuUfaUfaCfgAf | 1064 | 310 |
| AM03292-SS | uAuAusCfsagcCfcCfuUfaUfuguUfaUfaCfga | 1065 | 310 |
| AM03293-SS | uAuAusCfsagcCfcCfuUfaUfuguuauaCfga | 1066 | 310 |
| AM03294-SS | uAuAuscsagccccuUfaUfuguuauacga | 1067 | 310 |
| AM03295-SS | uAuAuscsagccccuuAfUfuguuauacga | 1068 | 310 |
| AM03296-SS | uAuAusCfsagcCfcCfuUfAfUfuguUfaUfaCfga | 1069 | 310 |
| AM03297-SS | uAuAusCfsagcCfcCfuUfAfUfuguuauaCfga | 1070 | 310 |
| AM03298-SS | uAuAuscsagccccuUfAfUfuguuauacga | 1071 | 310 |
| AM03299-SS | uAuAusCfsagcCfcCfuuAfUfuguuauaCfga | 1072 | 310 |
| AM03277-SS | uAuAuscsagccccuUfaUfuguuauacga(C11-PEG3-NAG3) | 1073 | 310 |
| AM03275-SS | uAuAusCfsagcCfcCfuUfaUfuguUfaUfaCfga(C11-PEG3-NAG3) | 1074 | 310 |
| AM03276-SS | uAuAusCfsagcCfcCfuUfaUfuguuauaCfga(C11-PEG3-NAG3) | 1075 | 310 |
| AM03278-SS | uAuAuscsagccccuuAfUfuguuauacga(C11-PEG3-NAG3) | 1076 | 310 |
| AM03287-SS | uAuAusCfsagcCfcCfuUfAfUfuguUfaUfaCfga(C11-PEG3-NAG3) | 1077 | 310 |
| AM03288-SS | uAuAusCfsagcCfcCfuUfAfUfuguuauaCfga(C11-PEG3-NAG3) | 1078 | 310 |
| AM03289-SS | uAuAuscsagccccuUfAfUfuguuauacga(C11-PEG3-NAG3) | 1079 | 310 |
| AM03290-SS | uAuAusCfsagcCfcCfuuAfUfuguuauaCfga(C11-PEG3-NAG3) | 1080 | 310 |
| AM03243-SS | uAuAusasguuaucgAfGfGfcucauucuca(C11-PEG3-NAG3) | 1081 | 308 |
| AM03424-SS | (Chol-TEG)uAuAusasguuaucgaGfGfcucauucuc(invdA) | 1082 | 308 |
| AM03425-SS | (Chol-TEG)uAuAusasguuaucgaGfGfcucauucuca | 1083 | 308 |
| AM03426-SS | (Chol-TEG)uAuAusAfgUfuAfuCfgAfGfGfcUfcAfuUfcUfc(invdA) | 1084 | 308 |
| AM03457-SS | CfscsCfcUfuAfuUfgUfuAfuAfca(NAG13) | 1085 | 334 |
| AM03458-SS | CfscsCfuUfaUfuGfuUfaUfaCfga(NAG13) | 1086 | 335 |
| AM03459-SS | AfsgsAfuGfcUfgAfgAfuUfcGfca(NAG13) | 1087 | 342 |
| AM03460-SS | GfsusUfaUfcGfaGfgCfcCfaUfua(NAG13) | 1088 | 344 |
| AM03461-SS | AfsusCfgAfgGfcUfcAfuUfcUfca(NAG13) | 1089 | 347 |
| AM03462-SS | AfsasCfaGfaAfuCfaGfgUfgUfca(NAG13) | 1090 | 350 |
| AM03489-SS | uAuAusasguuaucgaGfGfcucauucuca(NAG13) | 1091 | 308 |
| AM03492-SS | uAuAusCfsaGfcCfcCfuUfAfUfuGfuUfaUfaCfga(NAG13) | 1092 | 310 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM03544-SS | uAuAuscsagcccCfuUfaUfuguuauacga(NAG13) | 1093 | 310 |
| AM03545-SS | uAuAuscsagccccuuAfUfuGfuuauacga(NAG13) | 1094 | 310 |
| AM03546-SS | uAuAuscsagccccuUfAfUfuguuauacga(NAG13) | 1095 | 310 |
| AM03547-SS | uAuAusAfsgUfuAfuCfgAfGfGfcUfcAfuUfcUfcAf(NAG13) | 1096 | 308 |
| AM03650-SS | uAuAusasguuaucgAfGfGfcucauucuca(NAG13) | 1097 | 308 |
| AM03651-SS | uAuAuscsaGfcCfcCfuUfAfUfuGfuUfaUfaCfga(NAG13) | 1098 | 310 |
| AM03670-SS | uAuAuscsagcgccuUfAfUfuguuauacga(NAG13) | 1099 | 352 |
| AM03683-SS | uAuAuscsaGfcCfcCfuUfAfUfuGfuUfaUfaCfga | 1100 | 310 |
| AM03741-SS | cscsccUfUfAfuuguuauaca(NAG13) | 1101 | 334 |
| AM03742-SS | cscsccUfUfAfuuguuauaCMAM(NAG13) | 1102 | 334 |
| AM03743-SS | CMsCMsccUfUfAfuuguuauaCMAM(NAG13) | 1103 | 334 |
| AM03746-SS | cscscuUfAfUfuguuauacga(NAG13) | 1104 | 335 |
| AM03747-SS | cscscuUfAfUfuguuauacGMAM(NAG13) | 1105 | 335 |
| AM03748-SS | CMsCMscuUfAfUfuguuauacGMAM(NAG13) | 1106 | 335 |
| AM03751-SS | asuscgAfGfGfcucauucuca(NAG13) | 1107 | 347 |
| AM03752-SS | asuscgAfGfGfcucauucuCMAM(NAG13) | 1108 | 347 |
| AM03753-SS | AMsTMscgAfGfGfcucauucuCMAM(NAG13) | 1109 | 353 |
| AM03757-SS | asascaGfAfAfucagguguca(NAG13) | 1110 | 350 |
| AM03758-SS | asascaGfAfAfucaggugucCMAM(NAG13) | 1111 | 350 |
| AM03759-SS | AMsAMscaGfAfAfucaggugucCMAM(NAG13) | 1112 | 350 |
| AM03859-SS | (NAG18)uauausasguuaucgAfGfGfcucauucuc(invdA) | 1113 | 308 |
| AM03861-SS | (NAG18)uauauscsaGfcCfcCfuUfAfUfuGfuUfaUfaCfg(invdA) | 1114 | 310 |
| AM03879-SS | (NAG4)uscaGfcCfcCfuUfAfUfuGfuUfaUfaCfgausu(invAb) | 1115 | 354 |
| AM03880-SS | (NAG4)uscaGfcCfcCfuUfAfUfuGfuUfaUfaCfgsa(invAb) | 1116 | 355 |
| AM03881-SS | (NAG24)uscaGfcCfcCfuUfAfUfuGfuUfaUfaCfgausu(invAb) | 1117 | 354 |
| AM03882-SS | (NAG4)usaguuaucgAfGfGfcucauucucausu(invAb) | 1118 | 356 |
| AM03928-SS | uAuAuscsagcccCfuUfAfUfuguuauacga(NAG13) | 1119 | 310 |
| AM03931-SS | uAuAusasguuauCfgAfGfGfcucauucuca(NAG13) | 1120 | 308 |
| AM03968-SS | (NAG4)uauauscaGfcCfcCfuUfAfUfuGfuUfaUfaCfgs(invdA) | 1121 | 310 |
| AM03970-SS | (NAG4)(invAb)GfcCfcCfuUfAfUfuGfuUfaUfaCfgausu(invAb) | 1122 | 357 |
| AM04138-SS | (NAG25)uauausasguuaucgAfGfGfcucauucuc(invdA) | 1123 | 308 |
| AM04152-SS | (Alk-PEG5-C6)uauausasguuaucgAfGfGfcucauucuCM(invdA) | 1124 | 308 |
| AM04214-SS | (Alk-SMPT-C6)uauausasguuaucgAfGfGfcucauucuCM(invdA) | 1125 | 308 |
| AM04233-SS | (NAG26)uauausasguuaucgAfGfGfcucauucuCM(invdA) | 1126 | 308 |
| AM04372-SS | (NAG27)uauausasguuaucgAfGfGfcucauucuCM(invdA) | 1127 | 308 |
| AM04381-SS | (NAG25)auauscsagccccuUfAfUfuguuauacga(invdT) | 1128 | 358 |
| AM04382-SS | (NAG25)uauscsagccccuUfAfUfuguuauacgau(invdT) | 1129 | 359 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM04391-SS | (NAG25)auausasguuaucgAfGfGfcucauucuca(invdT) | 1130 | 360 |
| AM04392-SS | (NAG25)uausasguuaucgAfGfGfcucauucucau(invdT) | 1131 | 361 |
| AM04412-SS | (NAG25)uauauscsagccccuUfAfUfuguuauacg(invdA) | 1132 | 310 |
| AM04414-SS | (NAG25)(invAb)gccccuUfAfUfuguuauacgauus(invAb) | 1133 | 357 |
| AM04416-SS | (NAG25)(invAb)uuaucgAfGfGfcucauucucausu(invAb) | 1134 | 362 |
| AM04496-SS | (NAG25)(invAb)GfcCfcCfuUfAfUfuGfuUfaUfaCfgausu(invAb) | 1135 | 357 |
| AM04497-SS | (NAG29)uauausasguuaucgAfGfGfcucauucuc(invdA) | 1136 | 308 |
| AM04499-SS | (NAG28)(invAb)GfcCfcCfuUfAfUfuGfuUfaUfaCfgausu(invAb) | 1137 | 357 |
| AM04498-SS | (NAG29)uauauaasuuaucgaGfGfcucauucucsa(invAb) | 1138 | 363 |
| AM04500-SS | (NAG30)(invAb)GfcCfcCfuUfAfUfuGfuUfaUfaCfgausu(invAb) | 1139 | 357 |
| AM04502-SS | (NAG25)uauauaasuuaucgaGfGfcucauucucsa(invAb) | 1140 | 363 |
| AM04535-SS | (NAG25)uauaucsasgccccuUfAfUfuguuauacg(invdA) | 1141 | 310 |
| AM04536-SS | (NAG25)uauaucasgccccuUfAfUfuguuauacg(invdA) | 1142 | 310 |
| AM04537-SS | (NAG25)uauauasguuaucgAfGfGfcucauucuc(invdA) | 1143 | 308 |
| AM04538-SS | (NAG25)uauauagsuuaucgAfGfGfcucauucuc(invdA) | 1144 | 308 |
| AM04543-SS | (NAG30)uscaGfcCfcCfuUfAfUfuGfuUfaUfaCfgsa(invAb) | 1145 | 355 |
| AM04578-SS | (NAG25)ggcsagccccuUfAfUfuguuauacgAMs(invdT)dT | 1146 | 364 |
| AM04588-SS | (NAG25)ggcsagccccuUfAfUfuguuauacgAMsuu(invdT) | 1147 | 365 |
| AM04579-SS | (NAG25)G$_{UNA}$gcsagccccuUfAfUfuguuauacgAMs(invdT)dT | 1148 | 364 |
| AM04580-SS | (NAG25)ggcs(invdA)gccccuUfAfUfuguuauacgAMs(invdT)dT | 1149 | 364 |
| AM04581-SS | (NAG25)csagccccuUfAfUfuguuauacgAMs(invdT)dTdTdT | 1150 | 366 |
| AM04611-SS | (NAG31)(invAb)GfcCfcCfuUfAfUfuGfuUfaUfaCfgausu(invAb) | 1151 | 357 |
| AM04612-SS | (NAG32)(invAb)GfcCfcCfuUfAfUfuGfuUfaUfaCfgausu(invAb) | 1152 | 357 |
| AM04669-SS | (NAG25)uauauagsusuaucgAfGfGfcucauucuc(invdA) | 1153 | 308 |
| AM04670-SS | (NAG25)uauauagususaucgAfGfGfcucauucuc(invdA) | 1154 | 308 |
| AM04671-SS | (NAG25)gcgausasguuaucgAfGfGfcucauucuc(invdA) | 1155 | 367 |
| AM04672-SS | (NAG25)ugaausasguuaucgAfGfGfcucauucuc(invdA) | 1156 | 368 |
| AM04673-SS | (NAG25)aucgusasguuaucgAfGfGfcucauucuc(invdA) | 1157 | 369 |
| AM04674-SS | (NAG25)u(invdA)uausasguuaucgAfGfGfcucauucuc(invdA) | 1158 | 308 |
| AM04675-SS | (NAG25)uaua(invdA)sasguuaucgAfGfGfcucauucuc(invdA) | 1159 | 370 |
| AM04676-SS | (NAG25)uauaus(invdA)sguuaucgAfGfGfcucauucuc(invdA) | 1160 | 308 |
| AM04726-SS | (NAG30)aGfcCfcCfuUfAfUfuGfuUfaUfaCfgsa(invAb) | 1161 | 371 |
| AM04727-SS | (NAG30)aaGfcCfcCfuUfAfUfuGfuUfaUfaCfgsa(invAb) | 1162 | 372 |
| AM04728-SS | (NAG30)sasGfcCfcCfuUfAfUfuGfuUfaUfaCfgas(invAb) | 1163 | 371 |
| AM04729-SS | (NAG30)gscaGfcCfcCfuUfAfUfuGfuUfaUfaCfgsa(invAb) | 1164 | 373 |
| AM04737-SS | (NAG25)uauauagsuuaucgaGfGfcucauucucsa(invAb) | 1165 | 374 |
| AM04741-SS | (NAG30)sgscaGfcCfcCfuUfAfUfuGfuUfaUfaCfgsa(invAb) | 1166 | 373 |
| AM04742-SS | (NAG33)(invAb)GfcCfcCfuUfAfUfuGfuUfaUfaCfgausu(invAb) | 1167 | 357 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM04743-SS | (NAG34)(invAb)GfcCfcCfuUfAfUfuGfuUfaUfaCfgausu(invAb) | 1168 | 357 |
| AM04744-SS | (NAG35)(invAb)GfcCfcCfuUfAfUfuGfuUfaUfaCfgausu(invAb) | 1169 | 357 |
| AM04803-SS | (NAG30)acGfcCfcCfuUfAfUfuGfuUfaUfaCfgsa(invAb) | 1170 | 375 |
| AM04804-SS | (NAG30)sasaGfcCfcCfuUfAfUfuGfuUfaUfaCfgas(invAb) | 1171 | 372 |
| AM04807-SS | (NAG30)sascGfcCfcCfuUfAfUfuGfuUfaUfaCfgas(invAb) | 1172 | 375 |
| AM04806-SS | (NAG30)sgscaGfcCfcCfuUfAfUfuGfuUfaUfaCfgas(invAb) | 1173 | 373 |
| AM04808-SS | (NAG31)sGfcCfcCfuUfAfUfuGfuUfaUfaCfgausu(invAb) | 1174 | 376 |
| AM04809-SS | (NAG31)saGfcCfcCfuUfAfUfUfuGfuUfaUfaCfgausu(invAb) | 1175 | 377 |
| AM04810-SS | (NAG31)sasaGfcCfcCfuUfAfUfUfuGfuUfaUfaCfgas(invAb) | 1176 | 372 |
| AM04811-SS | (NAG31)sasaGfcCfcCfuUfAfUfUfuGfuUfaUfaCfgausu(invAb) | 1177 | 378 |
| AM04812-SS | (NAG31)sasaGfcCfcCfuUfAfUfUfuGfuUfaUfaCfg(invdA)usu(invAb) | 1178 | 378 |
| AM04813-SS | (NAG31)uauausasguuaucgAfGfGfcucauucuc(invdA) | 1179 | 308 |
| AM04816-SS | (NAG31)uauscsagccccuUfAfUfuguuauacgs(invdA) | 1180 | 379 |
| AM04817-SS | (NAG31)uagscsagccccuUfAfUfuguuauacgs(invdA) | 1181 | 380 |
| AM04835-SS | (NAG31)uaucagccccuUfAfUfuguuauacgs(invdA) | 1182 | 379 |
| AM04819-SS | (NAG31)sgscagccccuUfAfUfuguuauacgs(invdA) | 1183 | 381 |
| AM04820-SS | (NAG31)sgscagccccuUfAfUfuguuauacgsa(invAb) | 1184 | 373 |
| AM04862-SS | (NAG25)auaagasguuaucgAfGfGfcucauucuc(invdA) | 1185 | 382 |
| AM04863-SS | (NAG25)auaagsasguuaucgAfGfGfcucauucuc(invdA) | 1186 | 382 |
| AM04864-SS | (NAG25)auaggcsagccccuUfAfUfuguuauacg(invdA) | 1187 | 383 |
| AM04865-SS | (NAG25)auaggscsagccccuUfAfUfuguuauacg(invdA) | 1188 | 383 |
| AM04866-SS | (NAG25)scsagccccuUfAfUfuguuauacgs(invdA) | 1189 | 384 |
| AM04867-SS | (NAG31)scsagccccuUfAfUfuguuauacgs(invdA) | 1190 | 384 |
| AM04868-SS | (NAG25)sgsccccuUfAfUfuguuauacgauus(invAb) | 1191 | 376 |
| AM04869-SS | (NAG31)sgsccccuUfAfUfuguuauacgauus(invAb) | 1192 | 376 |
| AM04870-SS | (NAG25)sGfsccccuUfAfUfuguuauacgauus(invAb) | 1193 | 376 |
| AM04978-SS | (NAG31)sGfscCfcCfuUfAfUfuGfuUfaUfaCfgauus(invAb) | 1194 | 376 |
| AM05070-SS | (NAG25)uauauscsagcccc(NOTA-dT)UfAfUfuguuauacg(invdA) | 1195 | 385 |
| AM05072-SS | (NAG25)(invAb)GfcCfcCf(NOTA-dT)UfAfUfuGfuUfaUfaCfgausu(invAb) | 1196 | 1241 |
| 1532-SS02 | uAuAusAfsgUfuAfuCfgAfGfGfcucAfuucuca | 1197 | 308 |
| 1532-SS03 | uAuAusAfsgUfuAfuCfgAfGfGfcucauUfcuca | 1198 | 308 |
| 1532-SS04 | uAuAusAfsgUfuAfuCfgAfGfGfcucauucUfca | 1199 | 308 |
| 1532-SS05 | uAuAusAfsgUfuAfuCfgAfGfGfcucauucucAf | 1200 | 308 |
| 1532-SS06 | uAuAusAfsgUfuAfuCfgAfgGfcUfcauucucAf | 1201 | 308 |
| 1532-SS07 | uAuAusAfsgUfuAfuCfgAfgGfcucAfuucucAf | 1202 | 308 |
| 1532-SS08 | uAuAusAfsgUfuAfuCfgAfgGfcucauUfcucAf | 1203 | 308 |
| 1532-SS09 | uAuAusAfsgUfuAfuCfgAfgGfcucauucUfcAf | 1204 | 308 |

TABLE 2B-continued

LPA RNAi agent sense strands having modified nucleotides.

| Sense Strand | SS Sequence 5' → 3' | SEQ ID NO. | SEQ ID NO. |
|---|---|---|---|
| 1532-SS10 | uAuAusAfsgUfuAfuCfgAfgGfcucauucucAf | 1205 | 308 |
| 1532-SS11 | uAuAusAfsgUfuAfuCfgaGfGfcucauucucAf | 1206 | 308 |
| 1532-SS12 | uAuAusAfsgUfuAfuCfgagGfcUfcauucucAf | 1207 | 308 |
| 1532-SS13 | uAuAusAfsgUfuAfuCfgagGfcucAfuucucAf | 1208 | 308 |
| 1532-SS14 | uAuAusAfsgUfuAfuCfgagGfcucauUfcucAf | 1209 | 308 |
| 1532-SS15 | uAuAusAfsgUfuAfuCfgagGfcucauucUfcAf | 1210 | 308 |
| 1532-SS16 | uAuAusAfsgUfuAfuCfgagGfcucauUfcUfcAf | 1211 | 308 |
| 1532-SS17 | uAuAusAfsgUfuauCfgAfgGfcucauUfcUfcAf | 1212 | 308 |
| 1532-SS18 | uAuAusAfsgUfuauCfgaGfGfcucauUfcUfcAf | 1213 | 308 |
| 1532-SS19 | uAuAusAfsgUfuauCfgagGfcUfcauUfcUfcAf | 1214 | 308 |
| 1532-SS20 | uAuAusAfsgUfuauCfgagGfcucAfuUfcUfcAf | 1215 | 308 |
| 1532-SS21 | uAuAusAfsgUfuauCfgagGfcUfcAfuUfcUfcAf | 1216 | 308 |
| 1532-SS22 | uAuAusAfsguuAfuCfgagGfcUfcAfuUfcUfcAf | 1217 | 308 |
| 1532-SS23 | uAuAusAfsguuauCfgAfgGfcUfcAfuUfcUfcAf | 1218 | 308 |
| 1532-SS24 | uAuAusAfsguuauCfgaGfGfcUfcAfuUfcUfcAf | 1219 | 308 |
| 1533-CfinSS | uAuAuscsaGfaAfacaGfAfAfucaGfgUfgUfcAf | 1220 | 309 |
| 1533-SS00 | uAuAusCfsaGfaAfaCfaGfAfAfuCfaGfgUfgUfcAf | 1221 | 309 |
| 1533-SS01 | uAuAusCfsaGfaAfaCfaGfAfAfuCfaGfguguca | 1222 | 309 |
| 1533-SS02 | uAuAusCfsaGfaAfaCfaGfAfAfuCfaggugUfca | 1223 | 309 |
| 1533-SS03 | uAuAusCfsaGfaAfaCfaGfAfAfuCfaggugucAf | 1224 | 309 |
| 1533-SS04 | uAuAusCfsaGfaAfaCfaGfAfAfuCfaggUfguca | 1225 | 309 |
| 1533-SS05 | uAuAusCfsaGfaAfaCfaGfaAfuCfaGfgugucAf | 1226 | 309 |
| 1533-SS06 | uAuAusCfsaGfaAfaCfaGfaAfuCfaggugUfcAf | 1227 | 309 |
| 1533-SS07 | uAuAusCfsaGfaAfaCfaGfaAfuCfaggUfgucAf | 1228 | 309 |
| 1533-SS08 | uAuAusCfsaGfaAfaCfagAfAfuCfaggugUfcAf | 1229 | 309 |
| 1533-SS09 | uAuAusCfsaGfaAfaCfagaAfuCfaggUfgUfcAf | 1230 | 309 |
| 1533-SS10 | uAuAusCfsaGfaAfaCfagaAfuCfaGfgugUfcAf | 1231 | 309 |
| 1533-SS11 1533-SS20 | uAuAusCfsaGfaaaCfagAfAfuCfaGfgUfgUfcAf | 1232 | 309 |
| 1533-SS12 | uAuAusCfsaGfaaaCfaGfaAfuCfaGfgUfgUfcAf | 1233 | 309 |
| 1533-SS13 | uAuAusCfsaGfaAfaCfagaAfuCfaGfgUfgUfcAf | 1234 | 309 |
| 1533-SS14 | uAuAusCfsaGfaaaCfagaAfuCfaGfgUfgUfcAf | 1235 | 309 |
| 1533-SS15 | uAuAusCfsagaAfaCfagaAfuCfaGfgUfgUfcAf | 1236 | 309 |
| 1533-SS16 | uAuAusCfsagaaaCfagAfAfuCfaGfgUfgUfcAf | 1237 | 309 |
| 1533-SS17 | uAuAusCfsagaaaCfaGfaAfuCfaGfgUfgUfcAf | 1238 | 309 |
| 1533-SS18 | uAuAusCfsagaaaCfaGfAfAfuCfaGfgUfgUfcAf | 1239 | 309 |
| 1533-SS19 | uAuAusCfsagaAfaCfagAfAfuCfaGfgUfgUfcAf | 1240 | 309 |
| AM05341-SS | (NAG37)(invAb)GfcCfcCfcfuUfAfUfuGfuUfaUfaCfgausu(invAb) | 1256 | 357 |

TABLE 2B-continued

LPA RNAi agent sense strands having modified nucleotides.

| Sense Strand | SS Sequence 5' → 3' ID | SEQ ID NO. | SEQ ID NO. |
|---|---|---|---|
| AM05342-SS | (NAG37)scsagccccuUfAfUfuguuauacgs(invdA) | 1257 | 381 |
| AM05489-SS | (NAG25)uauausasguuaucgAfGfGfcucauucucas(invAb) | 1269 | 308 |
| AM05491-SS | (NAG25)(invAb)uuaucgAfGfGfcucauucucas(invAb) | 1270 | 1258 |
| AM05494-SS | (NAG25)(invAb)GfcCfcCfuUfAfUfuGfuUfaUfaCfgas(invAb) | 1271 | 1259 |
| AM05499-SS | (NAG25)(invAb)gccccuUfAfUfuguuauacgausu | 1272 | 357 |
| AM05500-SS | (NAG25)uauauscsagccccuUfAfUfuguuauacgas(invAb) | 1273 | 310 |
| AM05501-SS | (NAG25)(invAb)gccccuUfAfUfuguuauacgas(invAb) | 1274 | 1259 |
| AM05502-SS | (NAG25)sasagccccuUfAfUfuguuauacgs(invdA) | 1275 | 1261 |
| AM05503-SS | (NAG25)scsagccccuUfAfUfuguuauacgas(invAb) | 1276 | 1260 |
| AM05504-SS | (NAG25)sgsccccuUfAfUfuguuauacgas(invAb) | 1277 | 371 |
| AM05505-SS | (NAG25)sgsccccuUfAfUfuguuauacgs(invdA) | 1278 | 371 |
| AM05506-SS | (NAG25)sasagccccuUfAfUfuguuauacgas(invAb) | 1279 | 1261 |

A sense strand containing a sequence listed in Table 2B can be hybridized to any antisense strand containing a sequence listed in Table 2A provided the two sequences have a region of at least 90% complementarity over a contiguous 16, 17, 18, 19, 20, or 21 nucleotide sequence. Representative LPA RNAi agents are represented by the Duplex ID Nos. shown in Tables 3A and 3B.

In some embodiments an LPA RNAi agent comprises of any of the Duplex ID Nos. presented herein. In some embodiments an LPA RNAi agent consists of any of the Duplex ID Nos. presented herein. In some embodiments, an LPA RNAi agent comprises the sense strand and antisense strand nucleotide sequences of any of the Duplex ID Nos. presented herein. In some embodiments, an LPA RNAi agent comprises the sense strand and antisense strand nucleotide sequences of any of the Duplex ID Nos. presented herein and a targeting group and/or linking group wherein the targeting group and/or linking group is covalently linked (i.e. conjugated) to the sense strand or the antisense strand. In some embodiments, an LPA RNAi agent comprises the sense strand and antisense strand modified nucleotide sequences of any of the Duplex ID Nos. presented herein. In some embodiments, an LPA RNAi agent comprises the sense strand and antisense strand modified nucleotide sequences of any of the Duplex ID Nos. presented herein and a targeting group and/or linking group wherein the targeting group and/or linking group is covalently linked to the sense strand or the antisense strand.

TABLE 3A

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD00571 | AM01240-AS | AM01173-SS | AD02120 | AM03257-AS | AM03229-SS | AD02500 | AM03107-AS | AM03295-SS |
| AD00572 | AM01241-AS | AM01174-SS | AD02121 | AM03257-AS | AM03230-SS | AD02501 | AM03279-AS | AM03295-SS |
| AD00573 | AM01242-AS | AM01175-SS | AD02122 | AM03257-AS | AM03231-SS | AD02502 | AM03280-AS | AM03295-SS |
| AD00574 | AM01243-AS | AM01176-SS | AD02123 | AM03257-AS | AM03232-SS | AD02503 | AM03281-AS | AM03295-SS |
| AD00575 | AM01244-AS | AM01177-SS | AD02124 | AM03257-AS | AM03233-SS | AD02504 | AM03282-AS | AM03295-SS |
| AD00576 | AM01245-AS | AM01178-SS | AD02125 | AM03257-AS | AM03234-SS | AD02505 | AM03283-AS | AM03295-SS |
| AD00577 | AM01246-AS | AM01179-SS | AD02126 | AM03257-AS | AM03235-SS | AD02506 | AM03284-AS | AM03295-SS |
| AD00578 | AM01247-AS | AM01180-SS | AD02127 | AM03257-AS | AM03236-SS | AD02507 | AM03300-AS | AM03295-SS |
| AD00579 | AM01248-AS | AM01181-SS | AD02128 | AM03257-AS | AM03237-SS | AD02508 | AM03301-AS | AM03295-SS |
| AD00580 | AM01249-AS | AM01182-SS | AD02129 | AM03258-AS | AM03220-SS | AD02509 | AM03107-AS | AM03296-SS |
| AD00581 | AM01250-AS | AM01183-SS | AD02130 | AM03258-AS | AM03221-SS | AD02510 | AM03279-AS | AM03296-SS |
| AD00582 | AM01251-AS | AM01184-SS | AD02131 | AM03258-AS | AM03222-SS | AD02511 | AM03280-AS | AM03296-SS |
| AD00583 | AM01252-AS | AM01185-SS | AD02132 | AM03258-AS | AM03223-SS | AD02512 | AM03281-AS | AM03296-SS |
| AD00584 | AM01253-AS | AM01186-SS | AD02133 | AM03258-AS | AM03224-SS | AD02513 | AM03282-AS | AM03296-SS |
| AD00585 | AM01254-AS | AM01187-SS | AD02134 | AM03258-AS | AM03225-SS | AD02514 | AM03283-AS | AM03296-SS |
| AD00586 | AM01255-AS | AM01188-SS | AD02135 | AM03258-AS | AM03226-SS | AD02515 | AM03284-AS | AM03296-SS |
| AD00587 | AM01256-AS | AM01189-SS | AD02136 | AM03258-AS | AM03227-SS | AD02516 | AM03300-AS | AM03296-SS |
| AD00588 | AM01257-AS | AM01190-SS | AD02137 | AM03258-AS | AM03228-SS | AD02517 | AM03301-AS | AM03296-SS |
| AD00589 | AM01258-AS | AM01191-SS | AD02138 | AM03258-AS | AM03229-SS | AD02518 | AM03107-AS | AM03297-SS |
| AD00590 | AM01259-AS | AM01192-SS | AD02139 | AM03258-AS | AM03230-SS | AD02519 | AM03279-AS | AM03297-SS |
| AD00591 | AM01260-AS | AM01193-SS | AD02140 | AM03258-AS | AM03231-SS | AD02520 | AM03280-AS | AM03297-SS |
| AD00592 | AM01261-AS | AM01194-SS | AD02141 | AM03258-AS | AM03232-SS | AD02521 | AM03281-AS | AM03297-SS |
| AD00593 | AM01262-AS | AM01195-SS | AD02142 | AM03258-AS | AM03233-SS | AD02522 | AM03282-AS | AM03297-SS |

TABLE 3A-continued

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD00594 | AM01263-AS | AM01196-SS | AD02143 | AM03258-AS | AM03234-SS | AD02523 | AM03283-AS | AM03297-SS |
| AD00595 | AM01264-AS | AM01197-SS | AD02144 | AM03258-AS | AM03235-SS | AD02524 | AM03284-AS | AM03297-SS |
| AD00596 | AM01265-AS | AM01198-SS | AD02145 | AM03258-AS | AM03236-SS | AD02525 | AM03300-AS | AM03297-SS |
| AD00597 | AM01266-AS | AM01199-SS | AD02146 | AM03258-AS | AM03237-SS | AD02526 | AM03301-AS | AM03297-SS |
| AD00598 | AM01267-AS | AM01200-SS | AD02147 | AM03259-AS | AM03220-SS | AD02527 | AM03107-AS | AM03298-SS |
| AD00599 | AM01268-AS | AM01201-SS | AD02148 | AM03259-AS | AM03221-SS | AD02528 | AM03279-AS | AM03298-SS |
| AD00600 | AM01269-AS | AM01202-SS | AD02149 | AM03259-AS | AM03222-SS | AD02529 | AM03280-AS | AM03298-SS |
| AD00601 | AM01270-AS | AM01203-SS | AD02150 | AM03259-AS | AM03223-SS | AD02530 | AM03281-AS | AM03298-SS |
| AD00602 | AM01271-AS | AM01204-SS | AD02151 | AM03259-AS | AM03224-SS | AD02531 | AM03282-AS | AM03298-SS |
| AD00603 | AM01272-AS | AM01205-SS | AD02152 | AM03259-AS | AM03225-SS | AD02532 | AM03283-AS | AM03298-SS |
| AD00604 | AM01273-AS | AM01206-SS | AD02153 | AM03259-AS | AM03226-SS | AD02533 | AM03284-AS | AM03298-SS |
| AD00605 | AM01274-AS | AM01207-SS | AD02154 | AM03259-AS | AM03227-SS | AD02534 | AM03300-AS | AM03298-SS |
| AD00606 | AM01275-AS | AM01208-SS | AD02155 | AM03259-AS | AM03228-SS | AD02535 | AM03301-AS | AM03298-SS |
| AD00607 | AM01276-AS | AM01209-SS | AD02156 | AM03259-AS | AM03229-SS | AD02536 | AM03107-AS | AM03299-SS |
| AD00608 | AM01277-AS | AM01210-SS | AD02157 | AM03259-AS | AM03230-SS | AD02537 | AM03279-AS | AM03299-SS |
| AD00609 | AM01278-AS | AM01211-SS | AD02158 | AM03259-AS | AM03231-SS | AD02538 | AM03280-AS | AM03299-SS |
| AD00610 | AM01279-AS | AM01212-SS | AD02159 | AM03259-AS | AM03232-SS | AD02539 | AM03281-AS | AM03299-SS |
| AD00611 | AM01280-AS | AM01213-SS | AD02160 | AM03259-AS | AM03233-SS | AD02540 | AM03282-AS | AM03299-SS |
| AD00612 | AM01281-AS | AM01214-SS | AD02161 | AM03259-AS | AM03234-SS | AD02541 | AM03283-AS | AM03299-SS |
| AD00613 | AM01282-AS | AM01215-SS | AD02162 | AM03259-AS | AM03235-SS | AD02542 | AM03284-AS | AM03299-SS |
| AD00614 | AM01283-AS | AM01216-SS | AD02163 | AM03259-AS | AM03236-SS | AD02543 | AM03300-AS | AM03299-SS |
| AD00615 | AM01284-AS | AM01217-SS | AD02164 | AM03259-AS | AM03237-SS | AD02544 | AM03301-AS | AM03299-SS |
| AD00616 | AM01285-AS | AM01218-SS | AD02165 | AM03260-AS | AM03220-SS | AD02545 | AM03301-AS | AM03277-SS |
| AD00617 | AM01286-AS | AM01219-SS | AD02166 | AM03260-AS | AM03221-SS | AD02546 | AM03107-AS | AM03275-SS |
| AD00618 | AM01287-AS | AM01220-SS | AD02167 | AM03260-AS | AM03222-SS | AD02547 | AM03107-AS | AM03276-SS |
| AD00619 | AM01288-AS | AM01221-SS | AD02168 | AM03260-AS | AM03223-SS | AD02548 | AM03107-AS | AM03277-SS |
| AD00620 | AM01289-AS | AM01222-SS | AD02169 | AM03260-AS | AM03224-SS | AD02549 | AM03107-AS | AM03278-SS |
| AD00621 | AM01290-AS | AM01223-SS | AD02170 | AM03260-AS | AM03225-SS | AD02550 | AM03107-AS | AM03287-SS |
| AD00622 | AM01291-AS | AM01224-SS | AD02171 | AM03260-AS | AM03226-SS | AD02551 | AM03107-AS | AM03288-SS |
| AD00623 | AM01292-AS | AM01225-SS | AD02172 | AM03260-AS | AM03227-SS | AD02552 | AM03107-AS | AM03289-SS |
| AD00624 | AM01293-AS | AM01226-SS | AD02173 | AM03260-AS | AM03228-SS | AD02553 | AM03107-AS | AM03290-SS |
| AD00625 | AM01294-AS | AM01227-SS | AD02174 | AM03260-AS | AM03229-SS | AD02554 | AM03279-AS | AM02537-SS |
| AD00626 | AM01295-AS | AM01228-SS | AD02175 | AM03260-AS | AM03230-SS | AD02555 | AM03280-AS | AM02537-SS |
| AD00627 | AM01296-AS | AM01229-SS | AD02176 | AM03260-AS | AM03231-SS | AD02556 | AM03281-AS | AM02537-SS |
| AD00628 | AM01297-AS | AM01230-SS | AD02177 | AM03260-AS | AM03232-SS | AD02557 | AM03282-AS | AM02537-SS |
| AD00629 | AM01298-AS | AM01231-SS | AD02178 | AM03260-AS | AM03233-SS | AD02558 | AM03283-AS | AM02537-SS |
| AD00630 | AM01299-AS | AM01232-SS | AD02179 | AM03260-AS | AM03234-SS | AD02559 | AM03284-AS | AM02537-SS |
| AD00631 | AM01300-AS | AM01233-SS | AD02180 | AM03260-AS | AM03235-SS | AD02560 | AM03300-AS | AM02537-SS |
| AD00632 | AM01301-AS | AM01234-SS | AD02181 | AM03260-AS | AM03236-SS | AD02561 | AM03301-AS | AM02537-SS |
| AD00633 | AM01302-AS | AM01235-SS | AD02182 | AM03260-AS | AM03237-SS | AD02609 | AM03375-AS | AM03277-SS |
| AD00634 | AM01303-AS | AM01236-SS | AD02183 | AM03261-AS | AM03220-SS | AD02610 | AM03376-AS | AM03277-SS |
| AD00635 | AM01304-AS | AM01237-SS | AD02184 | AM03261-AS | AM03221-SS | AD02611 | AM03375-AS | AM03278-SS |
| AD00636 | AM01305-AS | AM01238-SS | AD02185 | AM03261-AS | AM03222-SS | AD02612 | AM03376-AS | AM03278-SS |
| AD00637 | AM01306-AS | AM01239-SS | AD02186 | AM03261-AS | AM03223-SS | AD02613 | AM03375-AS | AM03289-SS |
| AD01068 | AM01796-AS | AM01795-SS | AD02187 | AM03261-AS | AM03224-SS | AD02614 | AM03376-AS | AM03289-SS |
| AD01069 | AM01798-AS | AM01797-SS | AD02188 | AM03261-AS | AM03225-SS | AD02615 | AM03377-AS | AM02941-SS |
| AD01070 | AM01800-AS | AM01799-SS | AD02189 | AM03261-AS | AM03226-SS | AD02616 | AM03259-AS | AM02941-SS |
| AD01071 | AM01802-AS | AM01801-SS | AD02190 | AM03261-AS | AM03227-SS | AD02617 | AM03377-AS | AM02942-SS |
| AD01072 | AM01804-AS | AM01803-SS | AD02191 | AM03261-AS | AM03228-SS | AD02618 | AM03259-AS | AM02942-SS |
| AD01073 | AM01806-AS | AM01805-SS | AD02192 | AM03261-AS | AM03229-SS | AD02619 | AM03377-AS | AM03243-SS |
| AD01074 | AM01808-AS | AM01807-SS | AD02193 | AM03261-AS | AM03230-SS | AD02620 | AM03259-AS | AM03243-SS |
| AD01075 | AM01810-AS | AM01809-SS | AD02194 | AM03261-AS | AM03231-SS | AD02662 | AM02860-AS | AM03424-SS |
| AD01076 | AM01812-AS | AM01811-SS | AD02195 | AM03261-AS | AM03232-SS | AD02663 | AM02860-AS | AM03425-SS |
| AD01077 | AM01814-AS | AM01813-SS | AD02196 | AM03261-AS | AM03233-SS | AD02664 | AM03427-AS | AM03426-SS |
| AD01078 | AM01816-AS | AM01815-SS | AD02197 | AM03261-AS | AM03234-SS | AD02682 | AM02775-AS | AM03457-SS |
| AD01079 | AM01818-AS | AM01817-SS | AD02198 | AM03261-AS | AM03235-SS | AD02683 | AM02776-AS | AM03458-SS |
| AD01184 | AM02003-AS | AM02006-SS | AD02199 | AM03261-AS | AM03236-SS | AD02684 | AM02783-AS | AM03459-SS |
| AD01185 | AM02004-AS | AM02006-SS | AD02200 | AM03261-AS | AM03237-SS | AD02685 | AM02785-AS | AM03460-SS |
| AD01186 | AM02005-AS | AM02006-SS | AD02201 | AM03262-AS | AM03220-SS | AD02686 | AM02788-AS | AM03461-SS |
| AD01187 | AM02007-AS | AM02010-SS | AD02202 | AM03262-AS | AM03221-SS | AD02687 | AM02791-AS | AM03462-SS |
| AD01188 | AM02008-AS | AM02010-SS | AD02203 | AM03262-AS | AM03222-SS | AD02696 | AM02860-AS | AM03243-SS |
| AD01189 | AM02009-AS | AM02010-SS | AD02204 | AM03262-AS | AM03223-SS | AD02697 | AM03107-AS | AM03277-SS |
| AD01190 | AM02011-AS | AM02014-SS | AD02205 | AM03262-AS | AM03224-SS | AD02698 | AM03107-AS | AM03278-SS |
| AD01191 | AM02012-AS | AM02014-SS | AD02206 | AM03262-AS | AM03225-SS | AD02699 | AM03107-AS | AM03289-SS |
| AD01192 | AM02013-AS | AM02014-SS | AD02207 | AM03262-AS | AM03226-SS | AD02710 | AM03486-AS | AM03489-SS |
| AD01193 | AM02015-AS | AM02018-SS | AD02208 | AM03262-AS | AM03227-SS | AD02711 | AM03487-AS | AM03489-SS |
| AD01194 | AM02016-AS | AM02018-SS | AD02209 | AM03262-AS | AM03228-SS | AD02712 | AM03488-AS | AM03489-SS |
| AD01195 | AM02017-AS | AM02018-SS | AD02210 | AM03262-AS | AM03229-SS | AD02713 | AM02860-AS | AM03489-SS |
| AD01196 | AM02019-AS | AM02022-SS | AD02211 | AM03262-AS | AM03230-SS | AD02714 | AM03490-AS | AM03492-SS |
| AD01197 | AM02020-AS | AM02022-SS | AD02212 | AM03262-AS | AM03231-SS | AD02715 | AM03491-AS | AM03492-SS |
| AD01198 | AM02021-AS | AM02022-SS | AD02213 | AM03262-AS | AM03232-SS | AD02716 | AM02531-AS | AM03492-SS |
| AD01199 | AM02023-AS | AM02026-SS | AD02214 | AM03262-AS | AM03233-SS | AD02717 | AM03107-AS | AM03492-SS |
| AD01200 | AM02024-AS | AM02026-SS | AD02215 | AM03262-AS | AM03234-SS | AD02745 | AM03107-AS | AM03544-SS |
| AD01201 | AM02025-AS | AM02026-SS | AD02216 | AM03262-AS | AM03235-SS | AD02746 | AM03283-AS | AM03544-SS |
| AD01202 | AM02027-AS | AM02030-SS | AD02217 | AM03262-AS | AM03236-SS | AD02747 | AM03300-AS | AM03544-SS |

TABLE 3A-continued

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD01203 | AM02028-AS | AM02030-SS | AD02218 | AM03262-AS | AM03237-SS | AD02748 | AM03107-AS | AM03545-SS |
| AD01204 | AM02029-AS | AM02030-SS | AD02219 | AM03263-AS | AM03220-SS | AD02749 | AM03283-AS | AM03545-SS |
| AD01205 | AM02031-AS | AM02034-SS | AD02220 | AM03263-AS | AM03221-SS | AD02750 | AM03300-AS | AM03545-SS |
| AD01206 | AM02032-AS | AM02034-SS | AD02221 | AM03263-AS | AM03222-SS | AD02751 | AM03107-AS | AM03546-SS |
| AD01207 | AM02033-AS | AM02034-SS | AD02222 | AM03263-AS | AM03223-SS | AD02752 | AM03283-AS | AM03546-SS |
| AD01208 | AM02035-AS | AM02038-SS | AD02223 | AM03263-AS | AM03224-SS | AD02753 | AM03300-AS | AM03546-SS |
| AD01209 | AM02036-AS | AM02038-SS | AD02224 | AM03263-AS | AM03225-SS | AD02754 | AM02534-AS | AM03547-SS |
| AD01210 | AM02037-AS | AM02038-SS | AD02225 | AM03263-AS | AM03226-SS | AD02755 | AM02857-AS | AM03547-SS |
| AD01211 | AM02039-AS | AM02042-SS | AD02226 | AM03263-AS | AM03227-SS | AD02819 | AM03377-AS | AM03650-SS |
| AD01212 | AM02040-AS | AM02042-SS | AD02227 | AM03263-AS | AM03228-SS | AD02820 | AM03259-AS | AM03650-SS |
| AD01213 | AM02041-AS | AM02042-SS | AD02228 | AM03263-AS | AM03229-SS | AD02821 | AM03129-AS | AM03651-SS |
| AD01328 | AM02240-SS | AM02211-SS | AD02229 | AM03263-AS | AM03230-SS | AD02825 | AM03655-AS | AM03650-SS |
| AD01329 | AM02241-AS | AM02212-SS | AD02230 | AM03263-AS | AM03231-SS | AD02826 | AM03656-AS | AM03650-SS |
| AD01330 | AM02242-AS | AM02213-SS | AD02231 | AM03263-AS | AM03232-SS | AD02827 | AM03657-AS | AM03650-SS |
| AD01331 | AM02243-AS | AM02214-SS | AD02232 | AM03263-AS | AM03233-SS | AD02828 | AM03658-AS | AM03650-SS |
| AD01332 | AM02244-AS | AM02215-SS | AD02233 | AM03263-AS | AM03234-SS | AD02829 | AM03659-AS | AM03650-SS |
| AD01333 | AM02245-AS | AM02216-SS | AD02234 | AM03263-AS | AM03235-SS | AD02830 | AM03660-AS | AM03650-SS |
| AD01334 | AM02246-AS | AM02217-SS | AD02235 | AM03263-AS | AM03236-SS | AD02831 | AM03661-AS | AM03650-SS |
| AD01335 | AM02247-AS | AM02218-SS | AD02236 | AM03263-AS | AM03237-SS | AD02832 | AM03269-AS | AM03650-SS |
| AD01336 | AM02248-AS | AM02219-SS | AD02237 | AM03264-AS | AM03220-SS | AD02841 | AM03671-AS | AM03670-SS |
| AD01337 | AM02249-AS | AM02220-SS | AD02238 | AM03264-AS | AM03221-SS | AD02842 | AM03672-AS | AM03546-SS |
| AD01338 | AM02250-AS | AM02221-SS | AD02239 | AM03264-AS | AM03222-SS | AD02843 | AM03673-AS | AM03546-SS |
| AD01339 | AM02251-AS | AM02222-SS | AD02240 | AM03264-AS | AM03223-SS | AD02844 | AM03674-AS | AM03546-SS |
| AD01340 | AM02252-AS | AM02223-SS | AD02241 | AM03264-AS | AM03224-SS | AD02845 | AM03675-AS | AM03546-SS |
| AD01341 | AM02253-AS | AM02224-SS | AD02242 | AM03264-AS | AM03225-SS | AD02846 | AM03676-AS | AM03546-SS |
| AD01342 | AM02254-AS | AM02225-SS | AD02243 | AM03264-AS | AM03226-SS | AD02847 | AM03677-AS | AM03546-SS |
| AD01343 | AM02255-AS | AM02226-SS | AD02244 | AM03264-AS | AM03227-SS | AD02848 | AM03678-AS | AM03650-SS |
| AD01344 | AM02256-AS | AM02227-SS | AD02245 | AM03264-AS | AM03228-SS | AD02849 | AM03679-AS | AM03650-SS |
| AD01345 | AM02257-AS | AM02228-SS | AD02246 | AM03264-AS | AM03229-SS | AD02850 | AM03680-AS | AM03650-SS |
| AD01346 | AM02258-AS | AM02229-SS | AD02247 | AM03264-AS | AM03230-SS | AD02851 | AM03681-AS | AM03650-SS |
| AD01347 | AM02259-AS | AM02230-SS | AD02248 | AM03264-AS | AM03231-SS | AD02852 | AM03682-AS | AM03650-SS |
| AD01348 | AM02260-AS | AM02231-SS | AD02249 | AM03264-AS | AM03232-SS | AD02853 | AM02860-AS | AM03237-SS |
| AD01349 | AM02261-AS | AM02232-SS | AD02250 | AM03264-AS | AM03233-SS | AD02854 | AM03377-AS | AM03225-SS |
| AD01350 | AM02262-AS | AM02233-SS | AD02251 | AM03264-AS | AM03234-SS | AD02855 | AM03129-AS | AM03683-SS |
| AD01351 | AM02263-AS | AM02234-SS | AD02252 | AM03264-AS | AM03235-SS | AD02907 | AM02775-AS | AM03741-SS |
| AD01352 | AM02264-AS | AM02235-SS | AD02253 | AM03264-AS | AM03236-SS | AD02908 | AM02775-AS | AM03742-SS |
| AD01353 | AM02265-AS | AM02236-SS | AD02254 | AM03264-AS | AM03237-SS | AD02909 | AM03743-AS | AM03743-SS |
| AD01354 | AM02266-AS | AM02237-SS | AD02255 | AM03265-AS | AM03220-SS | AD02910 | AM03744-AS | AM03457-SS |
| AD01355 | AM02267-AS | AM02238-SS | AD02256 | AM03265-AS | AM03221-SS | AD02911 | AM03745-AS | AM03457-SS |
| AD01356 | AM02268-AS | AM02239-SS | AD02257 | AM03265-AS | AM03222-SS | AD02912 | AM03745-AS | AM03742-SS |
| AD01462 | AM02404-SS | AM02441-SS | AD02258 | AM03265-AS | AM03223-SS | AD02913 | AM02776-AS | AM03746-SS |
| AD01463 | AM02406-AS | AM02442-SS | AD02259 | AM03265-AS | AM03224-SS | AD02914 | AM02776-AS | AM03747-SS |
| AD01464 | AM02408-AS | AM02443-SS | AD02260 | AM03265-AS | AM03225-SS | AD02915 | AM02776-AS | AM03748-SS |
| AD01465 | AM02410-AS | AM02444-SS | AD02261 | AM03265-AS | AM03226-SS | AD02916 | AM03749-AS | AM03458-SS |
| AD01466 | AM02412-AS | AM02445-SS | AD02262 | AM03265-AS | AM03227-SS | AD02917 | AM03750-AS | AM03458-SS |
| AD01467 | AM02414-AS | AM02446-SS | AD02263 | AM03265-AS | AM03228-SS | AD02918 | AM03750-AS | AM03747-SS |
| AD01468 | AM02416-AS | AM02447-SS | AD02264 | AM03265-AS | AM03229-SS | AD02919 | AM02788-AS | AM03751-SS |
| AD01469 | AM02418-AS | AM02448-SS | AD02265 | AM03265-AS | AM03230-SS | AD02920 | AM02788-AS | AM03752-SS |
| AD01529 | AM02531-SS | AM02537-SS | AD02266 | AM03265-AS | AM03231-SS | AD02921 | AM02788-AS | AM03753-SS |
| AD01530 | AM02532-AS | AM02538-SS | AD02267 | AM03265-AS | AM03232-SS | AD02922 | AM03754-AS | AM03461-SS |
| AD01531 | AM02533-AS | AM02539-SS | AD02268 | AM03265-AS | AM03233-SS | AD02923 | AM03755-AS | AM03461-SS |
| AD01532 | AM02534-AS | AM02540-SS | AD02269 | AM03265-AS | AM03234-SS | AD02924 | AM03756-AS | AM03461-SS |
| AD01533 | AM02535-AS | AM02541-SS | AD02270 | AM03265-AS | AM03235-SS | AD02925 | AM03756-AS | AM03752-SS |
| AD01534 | AM02536-AS | AM02542-SS | AD02271 | AM03265-AS | AM03236-SS | AD02926 | AM02791-AS | AM03757-SS |
| AD01708 | AM02755-AS | AM02793-SS | AD02272 | AM03265-AS | AM03237-SS | AD02927 | AM02791-AS | AM03758-SS |
| AD01709 | AM02756-AS | AM02794-SS | AD02273 | AM03266-AS | AM03220-SS | AD02928 | AM02791-AS | AM03759-SS |
| AD01710 | AM02757-AS | AM02795-SS | AD02274 | AM03266-AS | AM03221-SS | AD02929 | AM03760-AS | AM03462-SS |
| AD01711 | AM02758-AS | AM02796-SS | AD02275 | AM03266-AS | AM03222-SS | AD02930 | AM03761-AS | AM03462-SS |
| AD01712 | AM02759-AS | AM02797-SS | AD02276 | AM03266-AS | AM03223-SS | AD02931 | AM03762-AS | AM03462-SS |
| AD01713 | AM02760-AS | AM02798-SS | AD02277 | AM03266-AS | AM03224-SS | AD02932 | AM03762-AS | AM03758-SS |
| AD01714 | AM02761-AS | AM02799-SS | AD02278 | AM03266-AS | AM03225-SS | AD03049 | AM03856-AS | AM03650-SS |
| AD01715 | AM02800-SS | AM02800-SS | AD02279 | AM03266-AS | AM03226-SS | AD03050 | AM03857-AS | AM03651-SS |
| AD01716 | AM02763-AS | AM02801-SS | AD02280 | AM03266-AS | AM03227-SS | AD03051 | AM03377-AS | AM03859-SS |
| AD01717 | AM02764-AS | AM02802-SS | AD02281 | AM03266-AS | AM03228-SS | AD03052 | AM03129-AS | AM03861-SS |
| AD01718 | AM02765-AS | AM02803-SS | AD02282 | AM03266-AS | AM03229-SS | AD03053 | AM03862-AS | AM03650-SS |
| AD01719 | AM02766-AS | AM02804-SS | AD02283 | AM03266-AS | AM03230-SS | AD03054 | AM03259-AS | AM03859-SS |
| AD01720 | AM02767-AS | AM02805-SS | AD02284 | AM03266-AS | AM03231-SS | AD03058 | AM03866-AS | AM03546-SS |
| AD01721 | AM02768-AS | AM02806-SS | AD02285 | AM03266-AS | AM03232-SS | AD03059 | AM03867-AS | AM03546-SS |
| AD01722 | AM02769-AS | AM02807-SS | AD02286 | AM03266-AS | AM03233-SS | AD03060 | AM03868-AS | AM03546-SS |
| AD01723 | AM02770-AS | AM02808-SS | AD02287 | AM03266-AS | AM03234-SS | AD03061 | AM03869-AS | AM03546-SS |
| AD01724 | AM02771-AS | AM02809-SS | AD02288 | AM03266-AS | AM03235-SS | AD03062 | AM03870-AS | AM03546-SS |
| AD01725 | AM02772-AS | AM02810-SS | AD02289 | AM03266-AS | AM03236-SS | AD03063 | AM03871-AS | AM03546-SS |
| AD01726 | AM02773-AS | AM02811-SS | AD02290 | AM03266-AS | AM03237-SS | AD03064 | AM03872-AS | AM03546-SS |
| AD01727 | AM02774-AS | AM02793-SS | AD02291 | AM03267-AS | AM03220-SS | AD03065 | AM03873-AS | AM03546-SS |
| AD01728 | AM02775-AS | AM02794-SS | AD02292 | AM03267-AS | AM03221-SS | AD03066 | AM03874-AS | AM03546-SS |

TABLE 3A-continued

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD01729 | AM02776-AS | AM02795-SS | AD02293 | AM03267-AS | AM03222-SS | AD03067 | AM03875-AS | AM03546-SS |
| AD01730 | AM02777-AS | AM02796-SS | AD02294 | AM03267-AS | AM03223-SS | AD03068 | AM03876-AS | AM03546-SS |
| AD01731 | AM02778-AS | AM02797-SS | AD02295 | AM03267-AS | AM03224-SS | AD03069 | AM03877-AS | AM03546-SS |
| AD01732 | AM02779-AS | AM02798-SS | AD02296 | AM03267-AS | AM03225-SS | AD03070 | AM03878-AS | AM03546-SS |
| AD01733 | AM02780-AS | AM02799-SS | AD02297 | AM03267-AS | AM03226-SS | AD03071 | AM03883-AS | AM03879-SS |
| AD01734 | AM02781-AS | AM02800-SS | AD02298 | AM03267-AS | AM03227-SS | AD03072 | AM03884-AS | AM03880-SS |
| AD01735 | AM02782-AS | AM02801-SS | AD02299 | AM03267-AS | AM03228-SS | AD03073 | AM03883-AS | AM03881-SS |
| AD01736 | AM02783-AS | AM02802-SS | AD02300 | AM03267-AS | AM03229-SS | AD03074 | AM03885-AS | AM03882-SS |
| AD01737 | AM02784-AS | AM02803-SS | AD02301 | AM03267-AS | AM03230-SS | AD03075 | AM03129-AS | AM03546-SS |
| AD01738 | AM02785-AS | AM02804-SS | AD02302 | AM03267-AS | AM03231-SS | AD03114 | AM03929-AS | AM03651-SS |
| AD01739 | AM02786-AS | AM02805-SS | AD02303 | AM03267-AS | AM03232-SS | AD03115 | AM03930-AS | AM03651-SS |
| AD01740 | AM02787-AS | AM02806-SS | AD02304 | AM03267-AS | AM03233-SS | AD03116 | AM03129-AS | AM03928-SS |
| AD01741 | AM02788-AS | AM02807-SS | AD02305 | AM03267-AS | AM03234-SS | AD03117 | AM03929-AS | AM03928-SS |
| AD01742 | AM02789-AS | AM02808-SS | AD02306 | AM03267-AS | AM03235-SS | AD03118 | AM03930-AS | AM03928-SS |
| AD01743 | AM02790-AS | AM02809-SS | AD02307 | AM03267-AS | AM03236-SS | AD03119 | AM03932-AS | AM03650-SS |
| AD01744 | AM02791-AS | AM02810-SS | AD02308 | AM03267-AS | AM03237-SS | AD03120 | AM03933-AS | AM03650-SS |
| AD01745 | AM02792-AS | AM02811-SS | AD02309 | AM03268-AS | AM03220-SS | AD03121 | AM03377-AS | AM03931-SS |
| AD01746 | AM02774-AS | AM02812-SS | AD02310 | AM03268-AS | AM03221-SS | AD03122 | AM03932-AS | AM03931-SS |
| AD01747 | AM02775-AS | AM02813-SS | AD02311 | AM03268-AS | AM03222-SS | AD03123 | AM03933-AS | AM03931-SS |
| AD01748 | AM02776-AS | AM02814-SS | AD02312 | AM03268-AS | AM03223-SS | AD03156 | AM03969-AS | AM03968-SS |
| AD01749 | AM02777-AS | AM02815-SS | AD02313 | AM03268-AS | AM03224-SS | AD03157 | AM03971-AS | AM03970-SS |
| AD01750 | AM02778-AS | AM02816-SS | AD02314 | AM03268-AS | AM03225-SS | AD03158 | AM03972-AS | AM03970-SS |
| AD01751 | AM02779-AS | AM02817-SS | AD02315 | AM03268-AS | AM03226-SS | AD03159 | AM03973-AS | AM03970-SS |
| AD01752 | AM02780-AS | AM02818-SS | AD02316 | AM03268-AS | AM03227-SS | AD03170 | AM03823-AS | AM03651-SS |
| AD01753 | AM02781-AS | AM02819-SS | AD02317 | AM03268-AS | AM03228-SS | AD03171 | AM03824-AS | AM03651-SS |
| AD01754 | AM02782-AS | AM02820-SS | AD02318 | AM03268-AS | AM03229-SS | AD03172 | AM03825-AS | AM03651-SS |
| AD01755 | AM02783-AS | AM02821-SS | AD02319 | AM03268-AS | AM03230-SS | AD03173 | AM03826-AS | AM03651-SS |
| AD01756 | AM02784-AS | AM02822-SS | AD02320 | AM03268-AS | AM03231-SS | AD03174 | AM03827-AS | AM03650-SS |
| AD01757 | AM02785-AS | AM02823-SS | AD02321 | AM03268-AS | AM03232-SS | AD03175 | AM03828-AS | AM03650-SS |
| AD01758 | AM02786-AS | AM02824-SS | AD02322 | AM03268-AS | AM03233-SS | AD03272 | AM02860-AS | AM04138-SS |
| AD01759 | AM02787-AS | AM02825-SS | AD02323 | AM03268-AS | AM03234-SS | AD03273 | AM03377-AS | AM04138-SS |
| AD01760 | AM02788-AS | AM02826-SS | AD02324 | AM03268-AS | AM03235-SS | AD03274 | AM04132-AS | AM04138-SS |
| AD01761 | AM02789-AS | AM02827-SS | AD02325 | AM03268-AS | AM03236-SS | AD03275 | AM04133-AS | AM04138-SS |
| AD01762 | AM02790-AS | AM02828-SS | AD02326 | AM03268-AS | AM03237-SS | AD03276 | AM04134-AS | AM04138-SS |
| AD01763 | AM02791-AS | AM02829-SS | AD02327 | AM03269-AS | AM03220-SS | AD03277 | AM04135-AS | AM04138-SS |
| AD01764 | AM02792-AS | AM02830-SS | AD02328 | AM03269-AS | AM03221-SS | AD03278 | AM04136-AS | AM04138-SS |
| AD01765 | AM02857-AS | AM02540-SS | AD02329 | AM03269-AS | AM03222-SS | AD03279 | AM04137-AS | AM04138-SS |
| AD01766 | AM02858-AS | AM02540-SS | AD02330 | AM03269-AS | AM03223-SS | AD03291 | AM04150-AS | AM04152-SS |
| AD01767 | AM02859-AS | AM02540-SS | AD02331 | AM03269-AS | AM03224-SS | AD03327 | AM04150-AS | AM04214-SS |
| AD01768 | AM02860-AS | AM02540-SS | AD02332 | AM03269-AS | AM03225-SS | AD03341 | AM04133-AS | AM04233-SS |
| AD01769 | AM02859-AS | AM02861-SS | AD02333 | AM03269-AS | AM03226-SS | AD03351 | AM04250-AS | AM03742-SS |
| AD01770 | AM02860-AS | AM02861-SS | AD02334 | AM03269-AS | AM03227-SS | AD03352 | AM04251-AS | AM03742-SS |
| AD01772 | AM02863-AS | AM02541-SS | AD02335 | AM03269-AS | AM03228-SS | AD03353 | AM04252-AS | AM03742-SS |
| AD01773 | AM02864-AS | AM02541-SS | AD02336 | AM03269-AS | AM03229-SS | AD03354 | AM04253-AS | AM03747-SS |
| AD01774 | AM02865-AS | AM02541-SS | AD02337 | AM03269-AS | AM03230-SS | AD03355 | AM04254-AS | AM03747-SS |
| AD01780 | AM02866-AS | AM02541-SS | AD02338 | AM03269-AS | AM03231-SS | AD03356 | AM04255-AS | AM03747-SS |
| AD01803 | AM02534-AS | AM02941-SS | AD02339 | AM03269-AS | AM03232-SS | AD03357 | AM04256-AS | AM03752-SS |
| AD01804 | AM02534-AS | AM02942-SS | AD02340 | AM03269-AS | AM03233-SS | AD03358 | AM04257-AS | AM03752-SS |
| AD01805 | AM02943-AS | AM02540-SS | AD02341 | AM03269-AS | AM03234-SS | AD03359 | AM04258-AS | AM03752-SS |
| AD01806 | AM02943-AS | AM02941-SS | AD02342 | AM03269-AS | AM03235-SS | AD03360 | AM04259-AS | AM03758-SS |
| AD01807 | AM02943-AS | AM02942-SS | AD02343 | AM03269-AS | AM03236-SS | AD03361 | AM04260-AS | AM03758-SS |
| AD01808 | AM02944-AS | AM02540-SS | AD02344 | AM03269-AS | AM03237-SS | AD03362 | AM04261-AS | AM03758-SS |
| AD01809 | AM02944-AS | AM02941-SS | AD02345 | AM03270-AS | AM03220-SS | AD03421 | AM04133-AS | AM04372-SS |
| AD01810 | AM02944-AS | AM02942-SS | AD02346 | AM03270-AS | AM03221-SS | AD03424 | AM04215-AS | AM03546-SS |
| AD01811 | AM02945-AS | AM02540-SS | AD02347 | AM03270-AS | AM03222-SS | AD03425 | AM04216-AS | AM03546-SS |
| AD01812 | AM02945-AS | AM02941-SS | AD02348 | AM03270-AS | AM03223-SS | AD03426 | AM04217-AS | AM03546-SS |
| AD01813 | AM02945-AS | AM02942-SS | AD02349 | AM03270-AS | AM03224-SS | AD03427 | AM04218-AS | AM03546-SS |
| AD01814 | AM02535-AS | AM02946-SS | AD02350 | AM03270-AS | AM03225-SS | AD03428 | AM04219-AS | AM03546-SS |
| AD01815 | AM02535-AS | AM02947-SS | AD02351 | AM03270-AS | AM03226-SS | AD03430 | AM04377-AS | AM04381-SS |
| AD01816 | AM02535-AS | AM02948-SS | AD02352 | AM03270-AS | AM03227-SS | AD03431 | AM04378-AS | AM04382-SS |
| AD01817 | AM02535-AS | AM02949-SS | AD02353 | AM03270-AS | AM03228-SS | AD03432 | AM04379-AS | AM04381-SS |
| AD01818 | AM02950-AS | AM02541-SS | AD02354 | AM03270-AS | AM03229-SS | AD03433 | AM04380-AS | AM04382-SS |
| AD01819 | AM02950-AS | AM02946-SS | AD02355 | AM03270-AS | AM03230-SS | AD03434 | AM04383-AS | AM04391-SS |
| AD01820 | AM02950-AS | AM02947-SS | AD02356 | AM03270-AS | AM03231-SS | AD03435 | AM04384-AS | AM04392-SS |
| AD01821 | AM02950-AS | AM02948-SS | AD02357 | AM03270-AS | AM03232-SS | AD03436 | AM04385-AS | AM04391-SS |
| AD01822 | AM02950-AS | AM02949-SS | AD02358 | AM03270-AS | AM03233-SS | AD03437 | AM04386-AS | AM04392-SS |
| AD01823 | AM02951-AS | AM02541-SS | AD02359 | AM03270-AS | AM03234-SS | AD03438 | AM04387-AS | AM04391-SS |
| AD01824 | AM02951-AS | AM02946-SS | AD02360 | AM03270-AS | AM03235-SS | AD03439 | AM04388-AS | AM04392-SS |
| AD01825 | AM02951-AS | AM02947-SS | AD02361 | AM03270-AS | AM03236-SS | AD03440 | AM04389-AS | AM04391-SS |
| AD01826 | AM02951-AS | AM02948-SS | AD02362 | AM03270-AS | AM03237-SS | AD03441 | AM04390-AS | AM04392-SS |
| AD01827 | AM02951-AS | AM02949-SS | AD02363 | AM03271-AS | AM03220-SS | AD03460 | AM03300-AS | AM04412-SS |
| AD01828 | AM02952-AS | AM02541-SS | AD02364 | AM03271-AS | AM03221-SS | AD03461 | AM04413-AS | AM04414-SS |
| AD01829 | AM02952-AS | AM02946-SS | AD02365 | AM03271-AS | AM03222-SS | AD03462 | AM04415-AS | AM04416-SS |
| AD01830 | AM02952-AS | AM02947-SS | AD02366 | AM03271-AS | AM03223-SS | AD03463 | AM04417-AS | AM04412-SS |
| AD01831 | AM02952-AS | AM02948-SS | AD02367 | AM03271-AS | AM03224-SS | AD03494 | AM04437-AS | AM03742-SS |

TABLE 3A-continued

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD01832 | AM02952-AS | AM02949-SS | AD02368 | AM03271-AS | AM03225-SS | AD03495 | AM04438-AS | AM03747-SS |
| AD01895 | AM02863-AS | AM03030-SS | AD02369 | AM03271-AS | AM03226-SS | AD03496 | AM04439-AS | AM03752-SS |
| AD01896 | AM02865-AS | AM03036-SS | AD02370 | AM03271-AS | AM03227-SS | AD03497 | AM04440-AS | AM03758-SS |
| AD01897 | AM02865-AS | AM03037-SS | AD02371 | AM03271-AS | AM03228-SS | AD03536 | AM03972-AS | AM04496-SS |
| AD01898 | AM02865-AS | AM03038-SS | AD02372 | AM03271-AS | AM03229-SS | AD03537 | AM02860-AS | AM04497-SS |
| AD01899 | AM03040-AS | AM03039-SS | AD02373 | AM03271-AS | AM03230-SS | AD03538 | AM03972-AS | AM04499-SS |
| AD01900 | AM03041-AS | AM03039-SS | AD02374 | AM03271-AS | AM03231-SS | AD03539 | AM04415-AS | AM04498-SS |
| AD01901 | AM03041-AS | AM03042-SS | AD02375 | AM03271-AS | AM03232-SS | AD03540 | AM03972-AS | AM04500-SS |
| AD01902 | AM02863-AS | AM03042-SS | AD02376 | AM03271-AS | AM03233-SS | AD03541 | AM04501-AS | AM03970-SS |
| AD01903 | AM03043-AS | AM03042-SS | AD02377 | AM03271-AS | AM03234-SS | AD03542 | AM02860-AS | AM04502-SS |
| AD01912 | AM03065-AS | AM03060-SS | AD02378 | AM03271-AS | AM03235-SS | AD03547 | AM04507-AS | AM04498-SS |
| AD01913 | AM03066-AS | AM03060-SS | AD02379 | AM03271-AS | AM03236-SS | AD03548 | AM02860-AS | AM04498-SS |
| AD01914 | AM03067-AS | AM03060-SS | AD02380 | AM03271-AS | AM03237-SS | AD03549 | AM04507-AS | AM04502-SS |
| AD01915 | AM03068-AS | AM03060-SS | AD02381 | AM03272-AS | AM03220-SS | AD03573 | AM04539-AS | AM04535-SS |
| AD01916 | AM03069-AS | AM03060-SS | AD02382 | AM03272-AS | AM03221-SS | AD03574 | AM04540-AS | AM04536-SS |
| AD01917 | AM03070-AS | AM03060-SS | AD02383 | AM03272-AS | AM03222-SS | AD03575 | AM04541-AS | AM04537-SS |
| AD01918 | AM03065-AS | AM03061-SS | AD02384 | AM03272-AS | AM03223-SS | AD03576 | AM04542-AS | AM04538-SS |
| AD01919 | AM03066-AS | AM03061-SS | AD02385 | AM03272-AS | AM03224-SS | AD03577 | AM04544-AS | AM04543-SS |
| AD01920 | AM03067-AS | AM03061-SS | AD02386 | AM03272-AS | AM03225-SS | AD03578 | AM04545-AS | AM04500-SS |
| AD01921 | AM03068-AS | AM03061-SS | AD02387 | AM03272-AS | AM03226-SS | AD03579 | AM04546-AS | AM04500-SS |
| AD01922 | AM03069-AS | AM03061-SS | AD02388 | AM03272-AS | AM03227-SS | AD03603 | AM04582-AS | AM04578-SS |
| AD01923 | AM03070-AS | AM03061-SS | AD02389 | AM03272-AS | AM03228-SS | AD03604 | AM04583-AS | AM04578-SS |
| AD01924 | AM03065-AS | AM03062-SS | AD02390 | AM03272-AS | AM03229-SS | AD03605 | AM04584-AS | AM04578-SS |
| AD01925 | AM03066-AS | AM03062-SS | AD02391 | AM03272-AS | AM03230-SS | AD03606 | AM04585-AS | AM04578-SS |
| AD01926 | AM03067-AS | AM03062-SS | AD02392 | AM03272-AS | AM03231-SS | AD03607 | AM04586-AS | AM04578-SS |
| AD01927 | AM03068-AS | AM03062-SS | AD02393 | AM03272-AS | AM03232-SS | AD03608 | AM04587-AS | AM04578-SS |
| AD01928 | AM03069-AS | AM03062-SS | AD02394 | AM03272-AS | AM03233-SS | AD03609 | AM04584-AS | AM04588-SS |
| AD01929 | AM03070-AS | AM03062-SS | AD02395 | AM03272-AS | AM03234-SS | AD03610 | AM04584-AS | AM04579-SS |
| AD01930 | AM03065-AS | AM03037-SS | AD02396 | AM03272-AS | AM03235-SS | AD03611 | AM04584-AS | AM04580-SS |
| AD01931 | AM03066-AS | AM03037-SS | AD02397 | AM03272-AS | AM03236-SS | AD03612 | AM04584-AS | AM04581-SS |
| AD01932 | AM03067-AS | AM03037-SS | AD02398 | AM03272-AS | AM03237-SS | AD03627 | AM04609-AS | AM03970-SS |
| AD01933 | AM03068-AS | AM03037-SS | AD02399 | AM03273-AS | AM03220-SS | AD03628 | AM04610-AS | AM03970-SS |
| AD01934 | AM03069-AS | AM03037-SS | AD02400 | AM03273-AS | AM03221-SS | AD03629 | AM03972-AS | AM04611-SS |
| AD01935 | AM03070-AS | AM03037-SS | AD02401 | AM03273-AS | AM03222-SS | AD03630 | AM03972-AS | AM04612-SS |
| AD01936 | AM03065-AS | AM03064-SS | AD02402 | AM03273-AS | AM03223-SS | AD03668 | AM04501-AS | AM04500-SS |
| AD01937 | AM03066-AS | AM03064-SS | AD02403 | AM03273-AS | AM03224-SS | AD03671 | AM04677-AS | AM04669-SS |
| AD01938 | AM03067-AS | AM03064-SS | AD02404 | AM03273-AS | AM03225-SS | AD03672 | AM04678-AS | AM04670-SS |
| AD01939 | AM03068-AS | AM03064-SS | AD02405 | AM03273-AS | AM03226-SS | AD03673 | AM04679-AS | AM04671-SS |
| AD01940 | AM03069-AS | AM03064-SS | AD02406 | AM03273-AS | AM03227-SS | AD03674 | AM04680-AS | AM04672-SS |
| AD01941 | AM03070-AS | AM03064-SS | AD02407 | AM03273-AS | AM03228-SS | AD03675 | AM04681-AS | AM04673-SS |
| AD01976 | AM03119-AS | AM02540-SS | AD02408 | AM03273-AS | AM03229-SS | AD03676 | AM02860-AS | AM04674-SS |
| AD01977 | AM03120-AS | AM02540-SS | AD02409 | AM03273-AS | AM03230-SS | AD03677 | AM02860-AS | AM04675-SS |
| AD01978 | AM03121-AS | AM02540-SS | AD02410 | AM03273-AS | AM03231-SS | AD03678 | AM02860-AS | AM04676-SS |
| AD01979 | AM02857-AS | AM03122-SS | AD02411 | AM03273-AS | AM03232-SS | AD03705 | AM04501-AS | AM04726-SS |
| AD01980 | AM02857-AS | AM03123-SS | AD02412 | AM03273-AS | AM03233-SS | AD03706 | AM04501-AS | AM04727-SS |
| AD01981 | AM03119-AS | AM03122-SS | AD02413 | AM03273-AS | AM03234-SS | AD03707 | AM04501-AS | AM04728-SS |
| AD01982 | AM02857-AS | AM03124-SS | AD02414 | AM03273-AS | AM03235-SS | AD03708 | AM04544-AS | AM04729-SS |
| AD01983 | AM03107-AS | AM02537-SS | AD02415 | AM03273-AS | AM03236-SS | AD03713 | AM04733-AS | AM04138-SS |
| AD01984 | AM03108-AS | AM02537-SS | AD02416 | AM03273-AS | AM03237-SS | AD03714 | AM04734-AS | AM04138-SS |
| AD01985 | AM03107-AS | AM03125-SS | AD02417 | AM03274-AS | AM03220-SS | AD03715 | AM04735-AS | AM04138-SS |
| AD01986 | AM03107-AS | AM03126-SS | AD02418 | AM03274-AS | AM03221-SS | AD03716 | AM04736-AS | AM04138-SS |
| AD01987 | AM03127-AS | AM02537-SS | AD02419 | AM03274-AS | AM03222-SS | AD03717 | AM02860-AS | AM04737-SS |
| AD01988 | AM03128-AS | AM02540-SS | AD02420 | AM03274-AS | AM03223-SS | AD03720 | AM03884-AS | AM04741-SS |
| AD01989 | AM03130-AS | AM02540-SS | AD02421 | AM03274-AS | AM03224-SS | AD03721 | AM03972-AS | AM04742-SS |
| AD01990 | AM03131-AS | AM02540-SS | AD02422 | AM03274-AS | AM03225-SS | AD03722 | AM03972-AS | AM04743-SS |
| AD02001 | AM02860-AS | AM02942-SS | AD02423 | AM03274-AS | AM03226-SS | AD03723 | AM03972-AS | AM04744-SS |
| AD02002 | AM02857-AS | AM03144-SS | AD02424 | AM03274-AS | AM03227-SS | AD03760 | AM04805-AS | AM04803-SS |
| AD02003 | AM03149-AS | AM02540-SS | AD02425 | AM03274-AS | AM03228-SS | AD03761 | AM04501-AS | AM04804-SS |
| AD02004 | AM03149-AS | AM02941-SS | AD02426 | AM03274-AS | AM03229-SS | AD03762 | AM04805-AS | AM04807-SS |
| AD02005 | AM03149-AS | AM02942-SS | AD02427 | AM03274-AS | AM03230-SS | AD03763 | AM03884-AS | AM04729-SS |
| AD02006 | AM03150-AS | AM02540-SS | AD02428 | AM03274-AS | AM03231-SS | AD03764 | AM03884-AS | AM04806-SS |
| AD02007 | AM03150-AS | AM02941-SS | AD02429 | AM03274-AS | AM03232-SS | AD03765 | AM04501-AS | AM04611-SS |
| AD02008 | AM03150-AS | AM02942-SS | AD02430 | AM03274-AS | AM03233-SS | AD03766 | AM04501-AS | AM04808-SS |
| AD02009 | AM03151-AS | AM02540-SS | AD02431 | AM03274-AS | AM03234-SS | AD03767 | AM04501-AS | AM04809-SS |
| AD02010 | AM03151-AS | AM02941-SS | AD02432 | AM03274-AS | AM03235-SS | AD03768 | AM04501-AS | AM04810-SS |
| AD02011 | AM03151-AS | AM02942-SS | AD02433 | AM03274-AS | AM03236-SS | AD03769 | AM04501-AS | AM04811-SS |
| AD02075 | AM03255-AS | AM03220-SS | AD02434 | AM03274-AS | AM03237-SS | AD03770 | AM04501-AS | AM04812-SS |
| AD02076 | AM03255-AS | AM03221-SS | AD02435 | AM03255-AS | AM03238-SS | AD03771 | AM02860-AS | AM04813-SS |
| AD02077 | AM03255-AS | AM03222-SS | AD02436 | AM03256-AS | AM03238-SS | AD03801 | AM04821-AS | AM04816-SS |
| AD02078 | AM03255-AS | AM03223-SS | AD02437 | AM03255-AS | AM03240-SS | AD03802 | AM04822-AS | AM04817-SS |
| AD02079 | AM03255-AS | AM03224-SS | AD02438 | AM03256-AS | AM03240-SS | AD03803 | AM04823-AS | AM04816-SS |
| AD02080 | AM03255-AS | AM03225-SS | AD02439 | AM03255-AS | AM02942-SS | AD03804 | AM04821-AS | AM04835-SS |
| AD02081 | AM03255-AS | AM03226-SS | AD02440 | AM03256-AS | AM02942-SS | AD03805 | AM04824-AS | AM04819-SS |
| AD02082 | AM03255-AS | AM03227-SS | AD02462 | AM02857-AS | AM03330-SS | AD03806 | AM04824-AS | AM04820-SS |
| AD02083 | AM03255-AS | AM03228-SS | AD02463 | AM03331-AS | AM01223-SS | AD03841 | AM04871-AS | AM04862-SS |

TABLE 3A-continued

LPA RNAi agent duplexes with Duplex ID numbers.

| Duplex ID | Antisense Strand ID | Sense Strand ID | Duplex ID | Antisense Strand ID | Sense Strand ID | Duplex ID | Antisense Strand ID | Sense Strand ID |
|---|---|---|---|---|---|---|---|---|
| AD02084 | AM03255-AS | AM03229-SS | AD02464 | AM03107-AS | AM03291-SS | AD03842 | AM02860-AS | AM04863-SS |
| AD02085 | AM03255-AS | AM03230-SS | AD02465 | AM03279-AS | AM03291-SS | AD03843 | AM04872-AS | AM04138-SS |
| AD02086 | AM03255-AS | AM03231-SS | AD02466 | AM03280-AS | AM03291-SS | AD03844 | AM04539-AS | AM04864-SS |
| AD02087 | AM03255-AS | AM03232-SS | AD02467 | AM03281-AS | AM03291-SS | AD03845 | AM03300-AS | AM04865-SS |
| AD02088 | AM03255-AS | AM03233-SS | AD02468 | AM03282-AS | AM03291-SS | AD03846 | AM04873-AS | AM04412-SS |
| AD02089 | AM03255-AS | AM03234-SS | AD02469 | AM03283-AS | AM03291-SS | AD03847 | AM04874-AS | AM04866-SS |
| AD02090 | AM03255-AS | AM03235-SS | AD02470 | AM03284-AS | AM03291-SS | AD03848 | AM04874-AS | AM04867-SS |
| AD02091 | AM03255-AS | AM03236-SS | AD02471 | AM03300-AS | AM03291-SS | AD03849 | AM04875-AS | AM04867-SS |
| AD02092 | AM03255-AS | AM03237-SS | AD02472 | AM03301-AS | AM03291-SS | AD03850 | AM04876-AS | AM04866-SS |
| AD02093 | AM03256-AS | AM03220-SS | AD02473 | AM03107-AS | AM03292-SS | AD03851 | AM04877-AS | AM04866-SS |
| AD02094 | AM03256-AS | AM03221-SS | AD02474 | AM03279-AS | AM03292-SS | AD03852 | AM04877-AS | AM04867-SS |
| AD02095 | AM03256-AS | AM03222-SS | AD02475 | AM03280-AS | AM03292-SS | AD03853 | AM04874-AS | AM04868-SS |
| AD02096 | AM03256-AS | AM03223-SS | AD02476 | AM03281-AS | AM03292-SS | AD03854 | AM04874-AS | AM04869-SS |
| AD02097 | AM03256-AS | AM03224-SS | AD02477 | AM03282-AS | AM03292-SS | AD03855 | AM04875-AS | AM04869-SS |
| AD02098 | AM03256-AS | AM03225-SS | AD02478 | AM03283-AS | AM03292-SS | AD03856 | AM04874-AS | AM04870-SS |
| AD02099 | AM03256-AS | AM03226-SS | AD02479 | AM03284-AS | AM03292-SS | AD03857 | AM03972-AS | AM04808-SS |
| AD02100 | AM03256-AS | AM03227-SS | AD02480 | AM03300-AS | AM03292-SS | AD03858 | AM03972-AS | AM04811-SS |
| AD02101 | AM03256-AS | AM03228-SS | AD02481 | AM03301-AS | AM03292-SS | AD03859 | AM04822-AS | AM04819-SS |
| AD02102 | AM03256-AS | AM03229-SS | AD02482 | AM03107-AS | AM03293-SS | AD03860 | AM04878-AS | AM04819-SS |
| AD02103 | AM03256-AS | AM03230-SS | AD02483 | AM03279-AS | AM03293-SS | AD03861 | AM04878-AS | AM04820-SS |
| AD02104 | AM03256-AS | AM03231-SS | AD02484 | AM03280-AS | AM03293-SS | AD03862 | AM04879-AS | AM04138-SS |
| AD02105 | AM03256-AS | AM03232-SS | AD02485 | AM03281-AS | AM03293-SS | AD03863 | AM04879-AS | AM04863-SS |
| AD02106 | AM03256-AS | AM03233-SS | AD02486 | AM03282-AS | AM03293-SS | AD03864 | AM04880-AS | AM04138-SS |
| AD02107 | AM03256-AS | AM03234-SS | AD02487 | AM03283-AS | AM03293-SS | AD03920 | AM04969-AS | AM04138-SS |
| AD02108 | AM03256-AS | AM03235-SS | AD02488 | AM03284-AS | AM03293-SS | AD03921 | AM04970-AS | AM04412-SS |
| AD02109 | AM03256-AS | AM03236-SS | AD02489 | AM03300-AS | AM03293-SS | AD03922 | AM04971-AS | AM04867-SS |
| AD02110 | AM03256-AS | AM03237-SS | AD02490 | AM03301-AS | AM03293-SS | AD03923 | AM04971-AS | AM04869-SS |
| AD02111 | AM03257-AS | AM03220-SS | AD02491 | AM03107-AS | AM03294-SS | AD03924 | AM04972-AS | AM04820-SS |
| AD02112 | AM03257-AS | AM03221-SS | AD02492 | AM03279-AS | AM03294-SS | AD03925 | AM04972-AS | AM04819-SS |
| AD02113 | AM03257-AS | AM03222-SS | AD02493 | AM03280-AS | AM03294-SS | AD03931 | AM04979-AS | AM04978-SS |
| AD02114 | AM03257-AS | AM03223-SS | AD02494 | AM03281-AS | AM03294-SS | AD03932 | AM04979-AS | AM04811-SS |
| AD02115 | AM03257-AS | AM03224-SS | AD02495 | AM03282-AS | AM03294-SS | AD03933 | AM04979-AS | AM04869-SS |
| AD02116 | AM03257-AS | AM03225-SS | AD02496 | AM03283-AS | AM03294-SS | AD04017 | AM03300-AS | AM05070-SS |
| AD02117 | AM03257-AS | AM03226-SS | AD02497 | AM03284-AS | AM03294-SS | AD04018 | AM03972-AS | AM05072-SS |
| AD02118 | AM03257-AS | AM03227-SS | AD02498 | AM03300-AS | AM03294-SS | AD04017 | AM03300-AS | AM05070-SS |
| AD02119 | AM03257-AS | AM03228-SS | AD02499 | AM03301-AS | AM03294-SS | AD04018 | AM03972-AS | AM05072-SS |
| AD04170 | AM03972-AS | AM05341-SS | AD04171 | AM04877-AS | AM05342-SS | AD04110 | AM04875-AS | AM04866-SS |
| AD04263 | AM04879-AS | AM05489-SS | AD04272 | AM04979-AS | AM05499-SS | AD04281 | AM05496-AS | AM04412-SS |
| AD04264 | AM05490-AS | AM04416-SS | AD04273 | AM03972-AS | AM05494-SS | AD04282 | AM04874-AS | AM05503-SS |
| AD04265 | AM05490-AS | AM05491-SS | AD04274 | AM05498-AS | AM05494-SS | AD04283 | AM04874-AS | AM05502-SS |
| AD04266 | AM05492-AS | AM04496-SS | AD04275 | AM04979-AS | AM05494-SS | AD04284 | AM04874-AS | AM05506-SS |
| AD04267 | AM05493-AS | AM04496-SS | AD04276 | AM03972-AS | AM05501-SS | AD04285 | AM04877-AS | AM05503-SS |
| AD04268 | AM05498-AS | AM04496-SS | AD04277 | AM05498-AS | AM05501-SS | AD04286 | AM05497-AS | AM05502-SS |
| AD04269 | AM04979-AS | AM04496-SS | AD04278 | AM04979-AS | AM05501-SS | AD04287 | AM05497-AS | AM05506-SS |
| AD04270 | AM03972-AS | AM05499-SS | AD04279 | AM03300-AS | AM05500-SS | AD04288 | AM04874-AS | AM05504-SS |
| AD04271 | AM05498-AS | AM05499-SS | AD04280 | AM05495-AS | AM04412-SS | AD04289 | AM04874-AS | AM05505-SS |

TABLE 3B

LPA RNAi agent duplexes with Duplex ID numbers.

| Duplex ID | Antisense Strand ID | Sense Strand ID |
|---|---|---|
| SD0001 | 1533-AS00 | 1533-SS00 |
| SD0002 | 1533-AS01 | 1533-SS00 |
| SD0003 | 1533-AS02 | 1533-SS00 |
| SD0004 | 1533-AS03 | 1533-SS00 |
| SD0005 | 1533-AS04 | 1533-SS00 |
| SD0006 | 1533-AS05 | 1533-SS00 |
| SD0007 | 1533-AS06 | 1533-SS00 |
| SD0008 | 1533-AS07 | 1533-SS00 |
| SD0009 | 1533-AS08 | 1533-SS00 |
| SD0010 | 1533-AS09 | 1533-SS00 |
| SD0011 | 1533-AS10 | 1533-SS00 |
| SD0012 | 1533-AS11 | 1533-SS00 |
| SD0013 | 1533-AS12 | 1533-SS00 |
| SD0014 | 1533-AS13 | 1533-SS00 |
| SD0015 | 1533-AS14 | 1533-SS00 |
| SD0016 | 1533-AS00 | 1533-SS01 |
| SD0017 | 1533-AS01 | 1533-SS01 |
| SD0018 | 1533-AS02 | 1533-SS01 |
| SD0019 | 1533-AS03 | 1533-SS01 |
| SD0020 | 1533-AS04 | 1533-SS01 |
| SD0021 | 1533-AS05 | 1533-SS01 |
| SD0022 | 1533-AS06 | 1533-SS01 |
| SD0023 | 1533-AS07 | 1533-SS01 |
| SD0024 | 1533-AS08 | 1533-SS01 |
| SD0025 | 1533-AS09 | 1533-SS01 |
| SD0026 | 1533-AS10 | 1533-SS01 |
| SD0027 | 1533-AS11 | 1533-SS01 |
| SD0028 | 1533-AS12 | 1533-SS01 |
| SD0029 | 1533-AS13 | 1533-SS01 |
| SD0030 | 1533-AS14 | 1533-SS01 |
| SD0031 | 1533-AS00 | 1533-SS02 |
| SD0032 | 1533-AS01 | 1533-SS02 |
| SD0033 | 1533-AS02 | 1533-SS02 |
| SD0034 | 1533-AS03 | 1533-SS02 |
| SD0035 | 1533-AS04 | 1533-SS02 |
| SD0036 | 1533-AS05 | 1533-SS02 |

TABLE 3B-continued

LPA RNAi agent duplexes with Duplex ID numbers.

| Duplex ID | Antisense Strand ID | Sense Strand ID |
|---|---|---|
| SD0037 | 1533-AS06 | 1533-SS02 |
| SD0038 | 1533-AS07 | 1533-SS02 |
| SD0039 | 1533-AS08 | 1533-SS02 |
| SD0040 | 1533-AS09 | 1533-SS02 |
| SD0041 | 1533-AS10 | 1533-SS02 |
| SD0042 | 1533-AS11 | 1533-SS02 |
| SD0043 | 1533-AS12 | 1533-SS02 |
| SD0044 | 1533-AS13 | 1533-SS02 |
| SD0045 | 1533-AS14 | 1533-SS02 |
| SD0046 | 1533-AS00 | 1533-SS03 |
| SD0047 | 1533-AS01 | 1533-SS03 |
| SD0048 | 1533-AS02 | 1533-SS03 |
| SD0049 | 1533-AS03 | 1533-SS03 |
| SD0050 | 1533-AS04 | 1533-SS03 |
| SD0051 | 1533-AS05 | 1533-SS03 |
| SD0052 | 1533-AS06 | 1533-SS03 |
| SD0053 | 1533-AS07 | 1533-SS03 |
| SD0054 | 1533-AS08 | 1533-SS03 |
| SD0055 | 1533-AS09 | 1533-SS03 |
| SD0056 | 1533-AS10 | 1533-SS03 |
| SD0057 | 1533-AS11 | 1533-SS03 |
| SD0058 | 1533-AS12 | 1533-SS03 |
| SD0059 | 1533-AS13 | 1533-SS03 |
| SD0060 | 1533-AS14 | 1533-SS03 |
| SD0061 | 1533-AS00 | 1533-SS04 |
| SD0062 | 1533-AS01 | 1533-SS04 |
| SD0063 | 1533-AS02 | 1533-SS04 |
| SD0064 | 1533-AS03 | 1533-SS04 |
| SD0065 | 1533-AS04 | 1533-SS04 |
| SD0066 | 1533-AS05 | 1533-SS04 |
| SD0067 | 1533-AS06 | 1533-SS04 |
| SD0068 | 1533-AS07 | 1533-SS04 |
| SD0069 | 1533-AS08 | 1533-SS04 |
| SD0070 | 1533-AS09 | 1533-SS04 |
| SD0071 | 1533-AS10 | 1533-SS04 |
| SD0072 | 1533-AS11 | 1533-SS04 |
| SD0073 | 1533-AS12 | 1533-SS04 |
| SD0074 | 1533-AS13 | 1533-SS04 |
| SD0075 | 1533-AS14 | 1533-SS04 |
| SD0076 | 1533-AS00 | 1533-SS05 |
| SD0077 | 1533-AS01 | 1533-SS05 |
| SD0078 | 1533-AS02 | 1533-SS05 |
| SD0079 | 1533-AS03 | 1533-SS05 |
| SD0080 | 1533-AS04 | 1533-SS05 |
| SD0081 | 1533-AS05 | 1533-SS05 |
| SD0082 | 1533-AS06 | 1533-SS05 |
| SD0083 | 1533-AS07 | 1533-SS05 |
| SD0084 | 1533-AS08 | 1533-SS05 |
| SD0085 | 1533-AS09 | 1533-SS05 |
| SD0086 | 1533-AS10 | 1533-SS05 |
| SD0087 | 1533-AS11 | 1533-SS05 |
| SD0088 | 1533-AS12 | 1533-SS05 |
| SD0089 | 1533-AS13 | 1533-SS05 |
| SD0090 | 1533-AS14 | 1533-SS05 |
| SD0091 | 1533-AS00 | 1533-SS06 |
| SD0092 | 1533-AS01 | 1533-SS06 |
| SD0093 | 1533-AS02 | 1533-SS06 |
| SD0094 | 1533-AS03 | 1533-SS06 |
| SD0095 | 1533-AS04 | 1533-SS06 |
| SD0096 | 1533-AS05 | 1533-SS06 |
| SD0097 | 1533-AS06 | 1533-SS06 |
| SD0098 | 1533-AS07 | 1533-SS06 |
| SD0099 | 1533-AS08 | 1533-SS06 |
| SD0100 | 1533-AS09 | 1533-SS06 |
| SD0101 | 1533-AS10 | 1533-SS06 |
| SD0102 | 1533-AS11 | 1533-SS06 |
| SD0103 | 1533-AS12 | 1533-SS06 |
| SD0104 | 1533-AS13 | 1533-SS06 |
| SD0105 | 1533-AS14 | 1533-SS06 |
| SD0106 | 1533-AS00 | 1533-SS07 |
| SD0107 | 1533-AS01 | 1533-SS07 |
| SD0108 | 1533-AS02 | 1533-SS07 |
| SD0109 | 1533-AS03 | 1533-SS07 |
| SD0110 | 1533-AS04 | 1533-SS07 |
| SD0111 | 1533-AS05 | 1533-SS07 |
| SD0112 | 1533-AS06 | 1533-SS07 |
| SD0113 | 1533-AS07 | 1533-SS07 |
| SD0114 | 1533-AS08 | 1533-SS07 |
| SD0115 | 1533-AS09 | 1533-SS07 |
| SD0116 | 1533-AS10 | 1533-SS07 |
| SD0117 | 1533-AS11 | 1533-SS07 |
| SD0118 | 1533-AS12 | 1533-SS07 |
| SD0119 | 1533-AS13 | 1533-SS07 |
| SD0120 | 1533-AS14 | 1533-SS07 |
| SD0121 | 1533-AS00 | 1533-SS08 |
| SD0122 | 1533-AS01 | 1533-SS08 |
| SD0123 | 1533-AS02 | 1533-SS08 |
| SD0124 | 1533-AS03 | 1533-SS08 |
| SD0125 | 1533-AS04 | 1533-SS08 |
| SD0126 | 1533-AS05 | 1533-SS08 |
| SD0127 | 1533-AS06 | 1533-SS08 |
| SD0128 | 1533-AS07 | 1533-SS08 |
| SD0129 | 1533-AS08 | 1533-SS08 |
| SD0130 | 1533-AS09 | 1533-SS08 |
| SD0131 | 1533-AS10 | 1533-SS08 |
| SD0132 | 1533-AS11 | 1533-SS08 |
| SD0133 | 1533-AS12 | 1533-SS08 |
| SD0134 | 1533-AS13 | 1533-SS08 |
| SD0135 | 1533-AS14 | 1533-SS08 |
| SD0136 | 1533-AS00 | 1533-SS09 |
| SD0137 | 1533-AS01 | 1533-SS09 |
| SD0138 | 1533-AS02 | 1533-SS09 |
| SD0139 | 1533-AS03 | 1533-SS09 |
| SD0140 | 1533-AS04 | 1533-SS09 |
| SD0141 | 1533-AS05 | 1533-SS09 |
| SD0142 | 1533-AS06 | 1533-SS09 |
| SD0143 | 1533-AS07 | 1533-SS09 |
| SD0144 | 1533-AS08 | 1533-SS09 |
| SD0145 | 1533-AS09 | 1533-SS09 |
| SD0146 | 1533-AS10 | 1533-SS09 |
| SD0147 | 1533-AS11 | 1533-SS09 |
| SD0148 | 1533-AS12 | 1533-SS09 |
| SD0149 | 1533-AS13 | 1533-SS09 |
| SD0150 | 1533-AS14 | 1533-SS09 |
| SD0151 | 1533-AS00 | 1533-SS01 |
| SD0152 | 1533-AS01 | 1533-SS01 |
| SD0153 | 1533-AS02 | 1533-SS01 |
| SD0154 | 1533-AS03 | 1533-SS01 |
| SD0155 | 1533-AS04 | 1533-SS01 |
| SD0156 | 1533-AS05 | 1533-SS01 |
| SD0157 | 1533-AS06 | 1533-SS01 |
| SD0158 | 1533-AS07 | 1533-SS01 |
| SD0159 | 1533-AS08 | 1533-SS01 |
| SD0160 | 1533-AS09 | 1533-SS01 |
| SD0161 | 1533-AS10 | 1533-SS01 |
| SD0162 | 1533-AS11 | 1533-SS01 |
| SD0163 | 1533-AS12 | 1533-SS01 |
| SD0164 | 1533-AS13 | 1533-SS01 |
| SD0165 | 1533-AS14 | 1533-SS01 |
| SD0166 | 1533-AS00 | 1533-SS01 |
| SD0167 | 1533-AS01 | 1533-SS01 |
| SD0168 | 1533-AS02 | 1533-SS01 |
| SD0169 | 1533-AS03 | 1533-SS01 |
| SD0170 | 1533-AS04 | 1533-SS01 |
| SD0171 | 1533-AS05 | 1533-SS01 |
| SD0172 | 1533-AS06 | 1533-SS01 |
| SD0173 | 1533-AS07 | 1533-SS01 |
| SD0174 | 1533-AS08 | 1533-SS01 |
| SD0175 | 1533-AS09 | 1533-SS01 |
| SD0176 | 1533-AS10 | 1533-SS01 |
| SD0177 | 1533-AS11 | 1533-SS01 |
| SD0178 | 1533-AS12 | 1533-SS01 |
| SD0179 | 1533-AS13 | 1533-SS01 |
| SD0180 | 1533-AS14 | 1533-SS01 |
| SD0181 | 1533-AS00 | 1533-SS02 |
| SD0182 | 1533-AS01 | 1533-SS02 |
| SD0183 | 1533-AS02 | 1533-SS02 |
| SD0184 | 1533-AS03 | 1533-SS02 |
| SD0185 | 1533-AS04 | 1533-SS02 |
| SD0186 | 1533-AS05 | 1533-SS02 |

TABLE 3B-continued

LPA RNAi agent duplexes with Duplex ID numbers.

| Duplex ID | Antisense Strand ID | Sense Strand ID |
|---|---|---|
| SD0187 | 1533-AS06 | 1533-SS02 |
| SD0188 | 1533-AS07 | 1533-SS02 |
| SD0189 | 1533-AS08 | 1533-SS02 |
| SD0190 | 1533-AS09 | 1533-SS02 |
| SD0191 | 1533-AS10 | 1533-SS02 |
| SD0192 | 1533-AS11 | 1533-SS02 |
| SD0193 | 1533-AS12 | 1533-SS02 |
| SD0194 | 1533-AS13 | 1533-SS02 |
| SD0195 | 1533-AS14 | 1533-SS02 |
| SD0196 | 1533-AS00 | 1533-CfinSS |
| SD0197 | 1533-AS01 | 1533-CfinSS |
| SD0198 | 1533-AS02 | 1533-CfinSS |
| SD0199 | 1533-AS03 | 1533-CfinSS |
| SD0200 | 1533-AS04 | 1533-CfinSS |
| SD0201 | 1533-AS05 | 1533-CfinSS |
| SD0202 | 1533-AS06 | 1533-CfinSS |
| SD0203 | 1533-AS07 | 1533-CfinSS |
| SD0204 | 1533-AS08 | 1533-CfinSS |
| SD0205 | 1533-AS09 | 1533-CfinSS |
| SD0206 | 1533-AS10 | 1533-CfinSS |
| SD0207 | 1533-AS11 | 1533-CfinSS |
| SD0208 | 1533-AS12 | 1533-CfinSS |
| SD0209 | 1533-AS13 | 1533-CfinSS |
| SD0210 | 1533-AS14 | 1533-CfinSS |
| SD0211 | 1533-CfinAS | 1533-SS00 |
| SD0212 | 1533-CfinAS | 1533-SS01 |
| SD0213 | 1533-CfinAS | 1533-SS02 |
| SD0214 | 1533-CfinAS | 1533-SS03 |
| SD0215 | 1533-CfinAS | 1533-SS04 |
| SD0216 | 1533-CfinAS | 1533-SS05 |
| SD0217 | 1533-CfinAS | 1533-SS06 |
| SD0218 | 1533-CfinAS | 1533-SS07 |
| SD0219 | 1533-CfinAS | 1533-SS08 |
| SD0220 | 1533-CfinAS | 1533-SS09 |
| SD0221 | 1533-CfinAS | 1533-SS10 |
| SD0222 | 1533-CfinAS | 1533-SS11 |
| SD0223 | 1533-CfinAS | 1533-SS12 |
| SD0224 | 1533-CfinAS | 1533-SS13 |
| SD0225 | 1533-CfinAS | 1533-SS14 |
| SD0226 | 1533-CfinAS | 1533-SS15 |
| SD0227 | 1533-CfinAS | 1533-SS16 |
| SD0228 | 1533-CfinAS | 1533-SS17 |
| SD0229 | 1533-CfinAS | 1533-SS18 |
| SD0230 | 1533-CfinAS | 1533-SS19 |
| SD0231 | 1533-CfinAS | 1533-SS20 |
| SD0232 | 1533-AS00 | 1533-SS12 |
| SD0233 | 1533-AS01 | 1533-SS12 |
| SD0234 | 1533-AS02 | 1533-SS12 |
| SD0235 | 1533-AS03 | 1533-SS12 |
| SD0236 | 1533-AS04 | 1533-SS12 |
| SD0237 | 1533-AS05 | 1533-SS12 |
| SD0238 | 1533-AS06 | 1533-SS12 |
| SD0239 | 1533-AS07 | 1533-SS12 |
| SD0240 | 1533-AS08 | 1533-SS12 |
| SD0241 | 1533-AS09 | 1533-SS12 |
| SD0242 | 1533-AS10 | 1533-SS12 |
| SD0243 | 1533-AS11 | 1533-SS12 |
| SD0244 | 1533-AS12 | 1533-SS12 |
| SD0245 | 1533-AS13 | 1533-SS12 |
| SD0246 | 1533-AS14 | 1533-SS12 |
| SD0247 | 1533-AS00 | 1533-SS13 |
| SD0248 | 1533-AS01 | 1533-SS13 |
| SD0249 | 1533-AS02 | 1533-SS13 |
| SD0250 | 1533-AS03 | 1533-SS13 |
| SD0251 | 1533-AS04 | 1533-SS13 |
| SD0252 | 1533-AS05 | 1533-SS13 |
| SD0253 | 1533-AS06 | 1533-SS13 |
| SD0254 | 1533-AS07 | 1533-SS13 |
| SD0255 | 1533-AS08 | 1533-SS13 |
| SD0256 | 1533-AS09 | 1533-SS13 |
| SD0257 | 1533-AS10 | 1533-SS13 |
| SD0258 | 1533-AS11 | 1533-SS13 |
| SD0259 | 1533-AS12 | 1533-SS13 |
| SD0260 | 1533-AS13 | 1533-SS13 |
| SD0261 | 1533-AS14 | 1533-SS13 |
| SD0262 | 1533-AS00 | 1533-SS14 |
| SD0263 | 1533-AS01 | 1533-SS14 |
| SD0264 | 1533-AS02 | 1533-SS14 |
| SD0265 | 1533-AS03 | 1533-SS14 |
| SD0266 | 1533-AS04 | 1533-SS14 |
| SD0267 | 1533-AS05 | 1533-SS14 |
| SD0268 | 1533-AS06 | 1533-SS14 |
| SD0269 | 1533-AS07 | 1533-SS14 |
| SD0270 | 1533-AS08 | 1533-SS14 |
| SD0271 | 1533-AS09 | 1533-SS14 |
| SD0272 | 1533-AS10 | 1533-SS14 |
| SD0273 | 1533-AS11 | 1533-SS14 |
| SD0274 | 1533-AS12 | 1533-SS14 |
| SD0275 | 1533-AS13 | 1533-SS14 |
| SD0276 | 1533-AS14 | 1533-SS14 |
| SD0277 | 1533-AS00 | 1533-SS15 |
| SD0278 | 1533-AS01 | 1533-SS15 |
| SD0279 | 1533-AS02 | 1533-SS15 |
| SD0280 | 1533-AS03 | 1533-SS15 |
| SD0281 | 1533-AS04 | 1533-SS15 |
| SD0282 | 1533-AS05 | 1533-SS15 |
| SD0283 | 1533-AS06 | 1533-SS15 |
| SD0284 | 1533-AS07 | 1533-SS15 |
| SD0285 | 1533-AS08 | 1533-SS15 |
| SD0286 | 1533-AS09 | 1533-SS15 |
| SD0287 | 1533-AS10 | 1533-SS15 |
| SD0288 | 1533-AS11 | 1533-SS15 |
| SD0289 | 1533-AS12 | 1533-SS15 |
| SD0290 | 1533-AS13 | 1533-SS15 |
| SD0291 | 1533-AS14 | 1533-SS15 |
| SD0292 | 1533-AS00 | 1533-SS16 |
| SD0293 | 1533-AS01 | 1533-SS16 |
| SD0294 | 1533-AS02 | 1533-SS16 |
| SD0295 | 1533-AS03 | 1533-SS16 |
| SD0296 | 1533-AS04 | 1533-SS16 |
| SD0297 | 1533-AS05 | 1533-SS16 |
| SD0298 | 1533-AS06 | 1533-SS16 |
| SD0299 | 1533-AS07 | 1533-SS16 |
| SD0300 | 1533-AS08 | 1533-SS16 |
| SD0301 | 1533-AS09 | 1533-SS16 |
| SD0302 | 1533-AS10 | 1533-SS16 |
| SD0303 | 1533-AS11 | 1533-SS16 |
| SD0304 | 1533-AS12 | 1533-SS16 |
| SD0305 | 1533-AS13 | 1533-SS16 |
| SD0306 | 1533-AS14 | 1533-SS16 |
| SD0307 | 1533-AS00 | 1533-SS17 |
| SD0308 | 1533-AS01 | 1533-SS17 |
| SD0309 | 1533-AS02 | 1533-SS17 |
| SD0310 | 1533-AS03 | 1533-SS17 |
| SD0311 | 1533-AS04 | 1533-SS17 |
| SD0312 | 1533-AS05 | 1533-SS17 |
| SD0313 | 1533-AS06 | 1533-SS17 |
| SD0314 | 1533-AS07 | 1533-SS17 |
| SD0315 | 1533-AS08 | 1533-SS17 |
| SD0316 | 1533-AS09 | 1533-SS17 |
| SD0317 | 1533-AS10 | 1533-SS17 |
| SD0318 | 1533-AS11 | 1533-SS17 |
| SD0319 | 1533-AS12 | 1533-SS17 |
| SD0320 | 1533-AS13 | 1533-SS17 |
| SD0321 | 1533-AS14 | 1533-SS17 |
| SD0322 | 1533-AS00 | 1533-SS18 |
| SD0323 | 1533-AS01 | 1533-SS18 |
| SD0324 | 1533-AS02 | 1533-SS18 |
| SD0325 | 1533-AS03 | 1533-SS18 |
| SD0326 | 1533-AS04 | 1533-SS18 |
| SD0327 | 1533-AS05 | 1533-SS18 |
| SD0328 | 1533-AS06 | 1533-SS18 |
| SD0329 | 1533-AS07 | 1533-SS18 |
| SD0330 | 1533-AS08 | 1533-SS18 |
| SD0331 | 1533-AS09 | 1533-SS18 |
| SD0332 | 1533-AS10 | 1533-SS18 |
| SD0333 | 1533-AS11 | 1533-SS18 |
| SD0334 | 1533-AS12 | 1533-SS18 |
| SD0335 | 1533-AS13 | 1533-SS18 |
| SD0336 | 1533-AS14 | 1533-SS18 |

TABLE 3B-continued

LPA RNAi agent duplexes with Duplex ID numbers.

| Duplex ID | Antisense Strand ID | Sense Strand ID |
|---|---|---|
| SD0337 | 1533-AS00 | 1533-SS19 |
| SD0338 | 1533-AS01 | 1533-SS19 |
| SD0339 | 1533-AS02 | 1533-SS19 |
| SD0340 | 1533-AS03 | 1533-SS19 |
| SD0341 | 1533-AS04 | 1533-SS19 |
| SD0342 | 1533-AS05 | 1533-SS19 |
| SD0343 | 1533-AS06 | 1533-SS19 |
| SD0344 | 1533-AS07 | 1533-SS19 |
| SD0345 | 1533-AS08 | 1533-SS19 |
| SD0346 | 1533-AS09 | 1533-SS19 |
| SD0347 | 1533-AS10 | 1533-SS19 |
| SD0348 | 1533-AS11 | 1533-SS19 |
| SD0349 | 1533-AS12 | 1533-SS19 |
| SD0350 | 1533-AS13 | 1533-SS19 |
| SD0351 | 1533-AS14 | 1533-SS19 |
| SD0352 | 1532-AS00 | 1532-SS00 |
| SD0353 | 1532-AS01 | 1532-SS00 |
| SD0354 | 1532-AS02 | 1532-SS00 |
| SD0355 | 1532-AS03 | 1532-SS00 |
| SD0356 | 1532-AS04 | 1532-SS00 |
| SD0357 | 1532-AS05 | 1532-SS00 |
| SD0358 | 1532-AS06 | 1532-SS00 |
| SD0359 | 1532-AS07 | 1532-SS00 |
| SD0360 | 1532-AS08 | 1532-SS00 |
| SD0361 | 1532-AS09 | 1532-SS00 |
| SD0362 | 1532-AS10 | 1532-SS00 |
| SD0363 | 1532-AS11 | 1532-SS00 |
| SD0364 | 1532-AS12 | 1532-SS00 |
| SD0365 | 1532-AS13 | 1532-SS00 |
| SD0366 | 1532-AS00 | 1532-SS01 |
| SD0367 | 1532-AS01 | 1532-SS01 |
| SD0368 | 1532-AS02 | 1532-SS01 |
| SD0369 | 1532-AS03 | 1532-SS01 |
| SD0370 | 1532-AS04 | 1532-SS01 |
| SD0371 | 1532-AS05 | 1532-SS01 |
| SD0372 | 1532-AS06 | 1532-SS01 |
| SD0373 | 1532-AS07 | 1532-SS01 |
| SD0374 | 1532-AS08 | 1532-SS01 |
| SD0375 | 1532-AS09 | 1532-SS01 |
| SD0376 | 1532-AS10 | 1532-SS01 |
| SD0377 | 1532-AS11 | 1532-SS01 |
| SD0378 | 1532-AS12 | 1532-SS01 |
| SD0379 | 1532-AS13 | 1532-SS01 |
| SD0380 | 1532-AS00 | 1532-SS02 |
| SD0381 | 1532-AS01 | 1532-SS02 |
| SD0382 | 1532-AS02 | 1532-SS02 |
| SD0383 | 1532-AS03 | 1532-SS02 |
| SD0384 | 1532-AS04 | 1532-SS02 |
| SD0385 | 1532-AS05 | 1532-SS02 |
| SD0386 | 1532-AS06 | 1532-SS02 |
| SD0387 | 1532-AS07 | 1532-SS02 |
| SD0388 | 1532-AS08 | 1532-SS02 |
| SD0389 | 1532-AS09 | 1532-SS02 |
| SD0390 | 1532-AS10 | 1532-SS02 |
| SD0391 | 1532-AS11 | 1532-SS02 |
| SD0392 | 1532-AS12 | 1532-SS02 |
| SD0393 | 1532-AS13 | 1532-SS02 |
| SD0394 | 1532-AS00 | 1532-SS03 |
| SD0395 | 1532-AS01 | 1532-SS03 |
| SD0396 | 1532-AS02 | 1532-SS03 |
| SD0397 | 1532-AS03 | 1532-SS03 |
| SD0398 | 1532-AS04 | 1532-SS03 |
| SD0399 | 1532-AS05 | 1532-SS03 |
| SD0400 | 1532-AS06 | 1532-SS03 |
| SD0401 | 1532-AS07 | 1532-SS03 |
| SD0402 | 1532-AS08 | 1532-SS03 |
| SD0403 | 1532-AS09 | 1532-SS03 |
| SD0404 | 1532-AS10 | 1532-SS03 |
| SD0405 | 1532-AS11 | 1532-SS03 |
| SD0406 | 1532-AS12 | 1532-SS03 |
| SD0407 | 1532-AS13 | 1532-SS03 |
| SD0408 | 1532-AS00 | 1532-SS04 |
| SD0409 | 1532-AS01 | 1532-SS04 |
| SD0410 | 1532-AS02 | 1532-SS04 |
| SD0411 | 1532-AS03 | 1532-SS04 |
| SD0412 | 1532-AS04 | 1532-SS04 |
| SD0413 | 1532-AS05 | 1532-SS04 |
| SD0414 | 1532-AS06 | 1532-SS04 |
| SD0415 | 1532-AS07 | 1532-SS04 |
| SD0416 | 1532-AS08 | 1532-SS04 |
| SD0417 | 1532-AS09 | 1532-SS04 |
| SD0418 | 1532-AS10 | 1532-SS04 |
| SD0419 | 1532-AS11 | 1532-SS04 |
| SD0420 | 1532-AS12 | 1532-SS04 |
| SD0421 | 1532-AS13 | 1532-SS04 |
| SD0422 | 1532-AS00 | 1532-SS05 |
| SD0423 | 1532-AS01 | 1532-SS05 |
| SD0424 | 1532-AS02 | 1532-SS05 |
| SD0425 | 1532-AS03 | 1532-SS05 |
| SD0426 | 1532-AS04 | 1532-SS05 |
| SD0427 | 1532-AS05 | 1532-SS05 |
| SD0428 | 1532-AS06 | 1532-SS05 |
| SD0429 | 1532-AS07 | 1532-SS05 |
| SD0430 | 1532-AS08 | 1532-SS05 |
| SD0431 | 1532-AS09 | 1532-SS05 |
| SD0432 | 1532-AS10 | 1532-SS05 |
| SD0433 | 1532-AS11 | 1532-SS05 |
| SD0434 | 1532-AS12 | 1532-SS05 |
| SD0435 | 1532-AS13 | 1532-SS05 |
| SD0436 | 1532-AS00 | 1532-SS06 |
| SD0437 | 1532-AS01 | 1532-SS06 |
| SD0438 | 1532-AS02 | 1532-SS06 |
| SD0439 | 1532-AS03 | 1532-SS06 |
| SD0440 | 1532-AS04 | 1532-SS06 |
| SD0441 | 1532-AS05 | 1532-SS06 |
| SD0442 | 1532-AS06 | 1532-SS06 |
| SD0443 | 1532-AS07 | 1532-SS06 |
| SD0444 | 1532-AS08 | 1532-SS06 |
| SD0445 | 1532-AS09 | 1532-SS06 |
| SD0446 | 1532-AS10 | 1532-SS06 |
| SD0447 | 1532-AS11 | 1532-SS06 |
| SD0448 | 1532-AS12 | 1532-SS06 |
| SD0449 | 1532-AS13 | 1532-SS06 |
| SD0450 | 1532-AS00 | 1532-SS07 |
| SD0451 | 1532-AS01 | 1532-SS07 |
| SD0452 | 1532-AS02 | 1532-SS07 |
| SD0453 | 1532-AS03 | 1532-SS07 |
| SD0454 | 1532-AS04 | 1532-SS07 |
| SD0455 | 1532-AS05 | 1532-SS07 |
| SD0456 | 1532-AS06 | 1532-SS07 |
| SD0457 | 1532-AS07 | 1532-SS07 |
| SD0458 | 1532-AS08 | 1532-SS07 |
| SD0459 | 1532-AS09 | 1532-SS07 |
| SD0460 | 1532-AS10 | 1532-SS07 |
| SD0461 | 1532-AS11 | 1532-SS07 |
| SD0462 | 1532-AS12 | 1532-SS07 |
| SD0463 | 1532-AS13 | 1532-SS07 |
| SD0464 | 1532-AS00 | 1532-SS08 |
| SD0465 | 1532-AS01 | 1532-SS08 |
| SD0466 | 1532-AS02 | 1532-SS08 |
| SD0467 | 1532-AS03 | 1532-SS08 |
| SD0468 | 1532-AS04 | 1532-SS08 |
| SD0469 | 1532-AS05 | 1532-SS08 |
| SD0470 | 1532-AS06 | 1532-SS08 |
| SD0471 | 1532-AS07 | 1532-SS08 |
| SD0472 | 1532-AS08 | 1532-SS08 |
| SD0473 | 1532-AS09 | 1532-SS08 |
| SD0474 | 1532-AS10 | 1532-SS08 |
| SD0475 | 1532-AS11 | 1532-SS08 |
| SD0476 | 1532-AS12 | 1532-SS08 |
| SD0477 | 1532-AS13 | 1532-SS08 |
| SD0478 | 1532-AS00 | 1532-SS09 |
| SD0479 | 1532-AS01 | 1532-SS09 |
| SD0480 | 1532-AS02 | 1532-SS09 |
| SD0481 | 1532-AS03 | 1532-SS09 |
| SD0482 | 1532-AS04 | 1532-SS09 |
| SD0483 | 1532-AS05 | 1532-SS09 |
| SD0484 | 1532-AS06 | 1532-SS09 |
| SD0485 | 1532-AS07 | 1532-SS09 |
| SD0486 | 1532-AS08 | 1532-SS09 |

TABLE 3B-continued

LPA RNAi agent duplexes with Duplex ID numbers.

| Duplex ID | Antisense Strand ID | Sense Strand ID |
|---|---|---|
| SD0487 | 1532-AS09 | 1532-SS09 |
| SD0488 | 1532-AS10 | 1532-SS09 |
| SD0489 | 1532-AS11 | 1532-SS09 |
| SD0490 | 1532-AS12 | 1532-SS09 |
| SD0491 | 1532-AS13 | 1532-SS09 |
| SD0492 | 1532-AS00 | 1532-SS10 |
| SD0493 | 1532-AS01 | 1532-SS10 |
| SD0494 | 1532-AS02 | 1532-SS10 |
| SD0495 | 1532-AS03 | 1532-SS10 |
| SD0496 | 1532-AS04 | 1532-SS10 |
| SD0497 | 1532-AS05 | 1532-SS10 |
| SD0498 | 1532-AS06 | 1532-SS10 |
| SD0499 | 1532-AS07 | 1532-SS10 |
| SD0500 | 1532-AS08 | 1532-SS10 |
| SD0501 | 1532-AS09 | 1532-SS10 |
| SD0502 | 1532-AS10 | 1532-SS10 |
| SD0503 | 1532-AS11 | 1532-SS10 |
| SD0504 | 1532-AS12 | 1532-SS10 |
| SD0505 | 1532-AS13 | 1532-SS10 |
| SD0506 | 1532-AS00 | 1532-SS11 |
| SD0507 | 1532-AS01 | 1532-SS11 |
| SD0508 | 1532-AS02 | 1532-SS11 |
| SD0509 | 1532-AS03 | 1532-SS11 |
| SD0510 | 1532-AS04 | 1532-SS11 |
| SD0511 | 1532-AS05 | 1532-SS11 |
| SD0512 | 1532-AS06 | 1532-SS11 |
| SD0513 | 1532-AS07 | 1532-SS11 |
| SD0514 | 1532-AS08 | 1532-SS11 |
| SD0515 | 1532-AS09 | 1532-SS11 |
| SD0516 | 1532-AS10 | 1532-SS11 |
| SD0517 | 1532-AS11 | 1532-SS11 |
| SD0518 | 1532-AS12 | 1532-SS11 |
| SD0519 | 1532-AS13 | 1532-SS11 |
| SD0520 | 1532-AS00 | 1532-SS12 |
| SD0521 | 1532-AS01 | 1532-SS12 |
| SD0522 | 1532-AS02 | 1532-SS12 |
| SD0523 | 1532-AS03 | 1532-SS12 |
| SD0524 | 1532-AS04 | 1532-SS12 |
| SD0525 | 1532-AS05 | 1532-SS12 |
| SD0526 | 1532-AS06 | 1532-SS12 |
| SD0527 | 1532-AS07 | 1532-SS12 |
| SD0528 | 1532-AS08 | 1532-SS12 |
| SD0529 | 1532-AS09 | 1532-SS12 |
| SD0530 | 1532-AS10 | 1532-SS12 |
| SD0531 | 1532-AS11 | 1532-SS12 |
| SD0532 | 1532-AS12 | 1532-SS12 |
| SD0533 | 1532-AS13 | 1532-SS12 |
| SD0534 | 1532-AS00 | 1532-SS13 |
| SD0535 | 1532-AS01 | 1532-SS13 |
| SD0536 | 1532-AS02 | 1532-SS13 |
| SD0537 | 1532-AS03 | 1532-SS13 |
| SD0538 | 1532-AS04 | 1532-SS13 |
| SD0539 | 1532-AS05 | 1532-SS13 |
| SD0540 | 1532-AS06 | 1532-SS13 |
| SD0541 | 1532-AS07 | 1532-SS13 |
| SD0542 | 1532-AS08 | 1532-SS13 |
| SD0543 | 1532-AS09 | 1532-SS13 |
| SD0544 | 1532-AS10 | 1532-SS13 |
| SD0545 | 1532-AS11 | 1532-SS13 |
| SD0546 | 1532-AS12 | 1532-SS13 |
| SD0547 | 1532-AS13 | 1532-SS13 |
| SD0548 | 1532-AS00 | 1532-SS14 |
| SD0549 | 1532-AS01 | 1532-SS14 |
| SD0550 | 1532-AS02 | 1532-SS14 |
| SD0551 | 1532-AS03 | 1532-SS14 |
| SD0552 | 1532-AS04 | 1532-SS14 |
| SD0553 | 1532-AS05 | 1532-SS14 |
| SD0554 | 1532-AS06 | 1532-SS14 |
| SD0555 | 1532-AS07 | 1532-SS14 |
| SD0556 | 1532-AS08 | 1532-SS14 |
| SD0557 | 1532-AS09 | 1532-SS14 |
| SD0558 | 1532-AS10 | 1532-SS14 |
| SD0559 | 1532-AS11 | 1532-SS14 |
| SD0560 | 1532-AS12 | 1532-SS14 |
| SD0561 | 1532-AS13 | 1532-SS14 |
| SD0562 | 1532-AS00 | 1532-SS15 |
| SD0563 | 1532-AS01 | 1532-SS15 |
| SD0564 | 1532-AS02 | 1532-SS15 |
| SD0565 | 1532-AS03 | 1532-SS15 |
| SD0566 | 1532-AS04 | 1532-SS15 |
| SD0567 | 1532-AS05 | 1532-SS15 |
| SD0568 | 1532-AS06 | 1532-SS15 |
| SD0569 | 1532-AS07 | 1532-SS15 |
| SD0570 | 1532-AS08 | 1532-SS15 |
| SD0571 | 1532-AS09 | 1532-SS15 |
| SD0572 | 1532-AS10 | 1532-SS15 |
| SD0573 | 1532-AS11 | 1532-SS15 |
| SD0574 | 1532-AS12 | 1532-SS15 |
| SD0575 | 1532-AS13 | 1532-SS15 |
| SD0576 | 1532-AS00 | 1532-SS16 |
| SD0577 | 1532-AS01 | 1532-SS16 |
| SD0578 | 1532-AS02 | 1532-SS16 |
| SD0579 | 1532-AS03 | 1532-SS16 |
| SD0580 | 1532-AS04 | 1532-SS16 |
| SD0581 | 1532-AS05 | 1532-SS16 |
| SD0582 | 1532-AS06 | 1532-SS16 |
| SD0583 | 1532-AS07 | 1532-SS16 |
| SD0584 | 1532-AS08 | 1532-SS16 |
| SD0585 | 1532-AS09 | 1532-SS16 |
| SD0586 | 1532-AS10 | 1532-SS16 |
| SD0587 | 1532-AS11 | 1532-SS16 |
| SD0588 | 1532-AS12 | 1532-SS16 |
| SD0589 | 1532-AS13 | 1532-SS16 |
| SD0590 | 1532-AS00 | 1532-SS17 |
| SD0591 | 1532-AS01 | 1532-SS17 |
| SD0592 | 1532-AS02 | 1532-SS17 |
| SD0593 | 1532-AS03 | 1532-SS17 |
| SD0594 | 1532-AS04 | 1532-SS17 |
| SD0595 | 1532-AS05 | 1532-SS17 |
| SD0596 | 1532-AS06 | 1532-SS17 |
| SD0597 | 1532-AS07 | 1532-SS17 |
| SD0598 | 1532-AS08 | 1532-SS17 |
| SD0599 | 1532-AS09 | 1532-SS17 |
| SD0600 | 1532-AS10 | 1532-SS17 |
| SD0601 | 1532-AS11 | 1532-SS17 |
| SD0602 | 1532-AS12 | 1532-SS17 |
| SD0603 | 1532-AS13 | 1532-SS17 |
| SD0604 | 1532-AS00 | 1532-SS18 |
| SD0605 | 1532-AS01 | 1532-SS18 |
| SD0606 | 1532-AS02 | 1532-SS18 |
| SD0607 | 1532-AS03 | 1532-SS18 |
| SD0608 | 1532-AS04 | 1532-SS18 |
| SD0609 | 1532-AS05 | 1532-SS18 |
| SD0610 | 1532-AS06 | 1532-SS18 |
| SD0611 | 1532-AS07 | 1532-SS18 |
| SD0612 | 1532-AS08 | 1532-SS18 |
| SD0613 | 1532-AS09 | 1532-SS18 |
| SD0614 | 1532-AS10 | 1532-SS18 |
| SD0615 | 1532-AS11 | 1532-SS18 |
| SD0616 | 1532-AS12 | 1532-SS18 |
| SD0617 | 1532-AS13 | 1532-SS18 |
| SD0618 | 1532-AS00 | 1532-SS19 |
| SD0619 | 1532-AS01 | 1532-SS19 |
| SD0620 | 1532-AS02 | 1532-SS19 |
| SD0621 | 1532-AS03 | 1532-SS19 |
| SD0622 | 1532-AS04 | 1532-SS19 |
| SD0623 | 1532-AS05 | 1532-SS19 |
| SD0624 | 1532-AS06 | 1532-SS19 |
| SD0625 | 1532-AS07 | 1532-SS19 |
| SD0626 | 1532-AS08 | 1532-SS19 |
| SD0627 | 1532-AS09 | 1532-SS19 |
| SD0628 | 1532-AS10 | 1532-SS19 |
| SD0629 | 1532-AS11 | 1532-SS19 |
| SD0630 | 1532-AS12 | 1532-SS19 |
| SD0631 | 1532-AS13 | 1532-SS19 |
| SD0632 | 1532-AS00 | 1532-SS20 |
| SD0633 | 1532-AS01 | 1532-SS20 |
| SD0634 | 1532-AS02 | 1532-SS20 |
| SD0635 | 1532-AS03 | 1532-SS20 |
| SD0636 | 1532-AS04 | 1532-SS20 |

TABLE 3B-continued

LPA RNAi agent duplexes with Duplex ID numbers.

| Duplex ID | Antisense Strand ID | Sense Strand ID |
|---|---|---|
| SD0637 | 1532-AS05 | 1532-SS20 |
| SD0638 | 1532-AS06 | 1532-SS20 |
| SD0639 | 1532-AS07 | 1532-SS20 |
| SD0640 | 1532-AS08 | 1532-SS20 |
| SD0641 | 1532-AS09 | 1532-SS20 |
| SD0642 | 1532-AS10 | 1532-SS20 |
| SD0643 | 1532-AS11 | 1532-SS20 |
| SD0644 | 1532-AS12 | 1532-SS20 |
| SD0645 | 1532-AS13 | 1532-SS20 |
| SD0646 | 1532-AS00 | 1532-SS21 |
| SD0647 | 1532-AS01 | 1532-SS21 |
| SD0648 | 1532-AS02 | 1532-SS21 |
| SD0649 | 1532-AS03 | 1532-SS21 |
| SD0650 | 1532-AS04 | 1532-SS21 |
| SD0651 | 1532-AS05 | 1532-SS21 |
| SD0652 | 1532-AS06 | 1532-SS21 |
| SD0653 | 1532-AS07 | 1532-SS21 |
| SD0654 | 1532-AS08 | 1532-SS21 |
| SD0655 | 1532-AS09 | 1532-SS21 |
| SD0656 | 1532-AS10 | 1532-SS21 |
| SD0657 | 1532-AS11 | 1532-SS21 |
| SD0658 | 1532-AS12 | 1532-SS21 |
| SD0659 | 1532-AS13 | 1532-SS21 |
| SD0660 | 1532-AS00 | 1532-SS22 |
| SD0661 | 1532-AS01 | 1532-SS22 |
| SD0662 | 1532-AS02 | 1532-SS22 |
| SD0663 | 1532-AS03 | 1532-SS22 |
| SD0664 | 1532-AS04 | 1532-SS22 |
| SD0665 | 1532-AS05 | 1532-SS22 |
| SD0666 | 1532-AS06 | 1532-SS22 |
| SD0667 | 1532-AS07 | 1532-SS22 |
| SD0668 | 1532-AS08 | 1532-SS22 |
| SD0669 | 1532-AS09 | 1532-SS22 |
| SD0670 | 1532-AS10 | 1532-SS22 |
| SD0671 | 1532-AS11 | 1532-SS22 |
| SD0672 | 1532-AS12 | 1532-SS22 |
| SD0673 | 1532-AS13 | 1532-SS22 |
| SD0674 | 1532-AS00 | 1532-SS23 |
| SD0675 | 1532-AS01 | 1532-SS23 |
| SD0676 | 1532-AS02 | 1532-SS23 |
| SD0677 | 1532-AS03 | 1532-SS23 |
| SD0678 | 1532-AS04 | 1532-SS23 |
| SD0679 | 1532-AS05 | 1532-SS23 |
| SD0680 | 1532-AS06 | 1532-SS23 |
| SD0681 | 1532-AS07 | 1532-SS23 |
| SD0682 | 1532-AS08 | 1532-SS23 |
| SD0683 | 1532-AS09 | 1532-SS23 |
| SD0684 | 1532-AS10 | 1532-SS23 |
| SD0685 | 1532-AS11 | 1532-SS23 |
| SD0686 | 1532-AS12 | 1532-SS23 |
| SD0687 | 1532-AS13 | 1532-SS23 |
| SD0688 | 1532-AS00 | 1532-SS24 |
| SD0689 | 1532-AS01 | 1532-SS24 |
| SD0690 | 1532-AS02 | 1532-SS24 |
| SD0691 | 1532-AS03 | 1532-SS24 |
| SD0692 | 1532-AS04 | 1532-SS24 |
| SD0693 | 1532-AS05 | 1532-SS24 |
| SD0694 | 1532-AS06 | 1532-SS24 |
| SD0695 | 1532-AS07 | 1532-SS24 |
| SD0696 | 1532-AS08 | 1532-SS24 |
| SD0697 | 1532-AS09 | 1532-SS24 |
| SD0698 | 1532-AS10 | 1532-SS24 |
| SD0699 | 1532-AS11 | 1532-SS24 |
| SD0700 | 1532-AS12 | 1532-SS24 |
| SD0701 | 1532-AS13 | 1532-SS24 |
| SD0702 | 1532-AS14 | 1532-SS00 |
| SD0703 | 1532-AS15 | 1532-SS00 |
| SD0704 | 1532-AS16 | 1532-SS00 |
| SD0705 | 1532-AS17 | 1532-SS00 |
| SD0706 | 1532-AS18 | 1532-SS00 |
| SD0707 | 1532-AS19 | 1532-SS00 |
| SD0708 | 1532-AS20 | 1532-SS00 |
| SD0709 | 1532-AS21 | 1532-SS00 |
| SD0710 | 1532-AS22 | 1532-SS00 |
| SD0711 | 1532-AS23 | 1532-SS00 |
| SD0712 | 1532-AS24 | 1532-SS00 |
| SD0713 | 1532-AS25 | 1532-SS00 |
| SD0714 | 1532-AS26 | 1532-SS00 |
| SD0715 | 1532-AS27 | 1532-SS00 |

In some embodiments, an LPA RNAi agent comprises an antisense strand comprising the nucleotide sequence of SEQ ID NO:1242 (TCGUAUAACAAUAAGGGGC). In some embodiments, an LPA RNAi agent comprises an antisense strand comprising the nucleotide sequence of SEQ ID NO:1244 (UCGUAUAACAAUAAGGGG). In some embodiments, an LPA RNAi agent comprises an antisense strand comprising the nucleotide sequence of SEQ ID NO:1246 (UCGUAUAACAAUAAGGG). In some embodiments, an LPA RNAi agent comprises an antisense strand comprising the nucleotide sequence of SEQ ID NO:1248 (TGAGAAUGAGCCUCGAUAA). In some embodiments, an LPA RNAi agent comprises an antisense strand comprising the nucleotide sequence of SEQ ID NO:1250 (UGAGAAUGAGCCUCGAUA). In some embodiments, an LPA RNAi agent comprises an antisense strand comprising the nucleotide sequence of SEQ ID NO:1252 (UGAGAAUGAGCCUCGAU). In some embodiments, an LPA RNAi agent comprises an antisense strand comprising the nucleotide sequence of SEQ ID NO:1254 (UGUAUAACAAUAAGGGG). In some embodiments, an LPA RNAi agent comprises an antisense strand comprising the nucleotide sequence of SEQ ID NO:1280 (CGUAUAACAAUAAGGGGC). In some embodiments, an LPA RNAi agent comprises an antisense strand comprising the nucleotide sequence of SEQ ID NO:1281 (GAGAAUGAGCCUCGAUAA). In some embodiments, an LPA RNAi agent comprises an antisense strand comprising the nucleotide sequence of SEQ ID NO:1282 (UCGUAUAACAAUAAGGGGC). In some embodiments, an LPA RNAi agent comprises an antisense strand comprising the nucleotide sequence of SEQ ID NO:1283 (UGAGAAUGAGCCUCGAUAA). In some embodiments, one or more of the nucleotides is modified.

In some embodiments, an LPA RNAi agent comprises a sense strand comprising the nucleotide sequence of SEQ ID NO:1243 (GCCCCUUAUUGUUAUACGA). In some embodiments, an LPA RNAi agent comprises a sense strand comprising the nucleotide sequence of SEQ ID NO:1245 (CCCCUUAUUGUUAUACGA). In some embodiments, an LPA RNAi agent comprises a sense strand comprising the nucleotide sequence of SEQ ID NO:1247 (CCCUUAUUGUUAUACGA). In some embodiments, an LPA RNAi agent comprises a sense strand comprising the nucleotide sequence of SEQ ID NO:1249 (UUAUCGAGGCUCAUUCUCA). In some embodiments, an LPA RNAi agent comprises a sense strand comprising the nucleotide sequence of SEQ ID NO:1251 (UAUCGAGGCUCAUUCUCA). In some embodiments, an LPA RNAi agent comprises a sense strand comprising the nucleotide sequence of SEQ ID NO:1253 (AUCGAGGCUCAUUCUCA). In some embodiments, an LPA RNAi agent comprises a sense strand comprising the nucleotide sequence of SEQ ID NO:1255 (CCCCUUAUUGUUAUACA). In some embodiments, an LPA RNAi agent comprises a sense strand comprising the nucleotide sequence of SEQ ID NO:1284 (GC- CCCUUAUUGUUAUACG). In some embodiments, an LPA RNAi agent comprises a sense strand comprising the nucleotide sequence of SEQ ID NO:1285 (UUAUCGAG-GCUCAUUCUC). In some embodiments, one or more of the nucleotides is modified.

In some embodiments, an LPA RNAi agent comprises an antisense strand comprising the nucleotide sequence of SEQ ID NO:1242 and a sense strand comprising the nucleotide sequence of SEQ ID NO:1243. In some embodiments, an LPA RNAi agent comprises an antisense strand comprising the nucleotide sequence of SEQ ID NO:1244 and a sense strand comprising the nucleotide sequence of SEQ ID NO:1245. In some embodiments, an LPA RNAi agent comprises an antisense strand comprising the nucleotide sequence of SEQ ID NO:1246 and a sense strand comprising the nucleotide sequence of SEQ ID NO:1247. In some embodiments, an LPA RNAi agent comprises an antisense strand comprising the nucleotide sequence of SEQ ID NO:1248 and a sense strand comprising the nucleotide sequence of SEQ ID NO:1249. In some embodiments, an LPA RNAi agent comprises an antisense strand comprising the nucleotide sequence of SEQ ID NO:1250 and a sense strand comprising the nucleotide sequence of SEQ ID NO:1251. In some embodiments, an LPA RNAi agent comprises an antisense strand comprising the nucleotide sequence of SEQ ID NO:1252 and a sense strand comprising the nucleotide sequence of SEQ ID NO:1253. In some embodiments, an LPA RNAi agent comprises an antisense strand comprising the nucleotide sequence of SEQ ID NO:1254 and sense strand comprising the nucleotide sequence of SEQ ID NO:1255. In some embodiments, an LPA RNAi agent comprises an antisense strand comprising the nucleotide sequence of SEQ ID NO:1280 and a sense strand comprising the nucleotide sequence of SEQ ID NO:1284. In some embodiments, an LPA RNAi agent comprises an antisense strand comprising the nucleotide sequence of SEQ ID NO:1281 and a sense strand comprising the nucleotide sequence of SEQ ID NO: 1285. In some embodiments, an LPA RNAi agent comprises an antisense strand comprising the nucleotide sequence of SEQ ID NO:1282 and a sense strand comprising the nucleotide sequence of SEQ ID NO:1259. In some embodiments, an LPA RNAi agent comprises an antisense strand comprising the nucleotide sequence of SEQ ID NO:1283 and a sense strand comprising the nucleotide sequence of SEQ ID NO: 1249. In some embodiments, one or more of the nucleotides is modified.

In some embodiments, an LPA RNAi agent comprises an antisense strand comprising the nucleotide sequence of SEQ ID NO. 156, 164, or 188. In some embodiments, an LPA RNAi agent comprises a sense strand comprising the nucleotide sequence of SEQ ID NO. 310, 357, 384, or 376. In some embodiments, an LPA RNAi agent comprises an antisense strand and a sense strand comprising the nucleotide sequences of SEQ ID NOs:156/310, SEQ ID NOs:164/357, SEQ ID NOs:188/384, SEQ ID NOs:164/376, or SEQ ID NOs:164/384. In some embodiments, one or more of the nucleotides is modified.

In some embodiments, an LPA RNAi agent comprises an antisense strand comprising the nucleotide sequence of SEQ ID NO. 637, 709, 790, 787, or 788. In some embodiments, an LPA RNAi agent comprises a sense strand comprising the nucleotide sequence of SEQ ID NO:1132, 1135, 1189, 1191, or 1186. In some embodiments, an LPA RNAi agent comprises an antisense strand and a sense strand comprising the nucleotide sequences of SEQ ID NOs:637/1132, SEQ ID NOs:709/1135, SEQ ID NOs:790/1189, SEQ ID NOs:787/1191, or SEQ ID NOs:788/1186.

In some embodiments, an LPA RNAi agent comprises SEQ ID NO. 637, 709, 790, 787, or 788. In some embodiments, an LPA RNAi agent comprises SEQ ID NO:1132, 1135, 1189, 1191, or 1186. In some embodiments, an LPA RNAi agent comprises SEQ ID NOs:637/1132, SEQ ID NOs:709/1135, SEQ ID NOs:790/1189, SEQ ID NOs:787/1191, or SEQ ID NOs:788/1186.

In some embodiments, an LPA RNAi agent consists of SEQ ID NO. 637, 709, 790, 787, or 788. In some embodiments, an LPA RNAi agent consists of SEQ ID NO:1132, 1135, 1189, 1191, or 1186. In some embodiments, an LPA RNAi agent consists of SEQ ID NOs:637/1132, SEQ ID NOs:709/1135, SEQ ID NOs:790/1189, SEQ ID NOs:787/1191, or SEQ ID NOs:788/1186.

In some embodiments, an LPA RNAi agent comprises an antisense strand and a sense strand having the nucleotide sequences of any of the antisense strand/sense strand duplexes of Table 3A or 3B.

In some embodiments, an LPA RNAi agent comprises an antisense strand and a sense strand having the nucleotide sequences of any of the antisense strand/sense strand duplexes of Table 3A or 3B, and further comprises an asialoglycoprotein receptor ligand targeting group.

In some embodiments, an LPA RNAi agent comprises an antisense strand and a sense strand having the nucleotide sequences of any of the antisense strand/sense strand duplexes of Table 3A or 3B, and further comprises a targeting group selected from the group consisting of (C11¬PEG3¬NAG3), (C11-PEG3-NAG3), (C6-PEG4-NAG3), (NAG3), (NAG4), (NAG3¬AA2), (NAG3-Palm), (NAG13), (NAG18), (NAG24), (NAG25), (NAG25)s, (NAG26), (NAG27) (NAG28) (NAG29) (NAG30) (NAG30)s, (NAG31), (NAG13), (NAG31s), (NAG32), (NAG33), (NAG34), (NAG35), (NAG36), and (NAG37).

In some embodiments, an LPA RNAi agent comprises an antisense strand and a sense strand having the modified nucleotide sequences of any of the antisense strand/sense strand duplexes of Table 3A or 3B.

In some embodiments, an LPA RNAi agent comprises an antisense strand and a sense strand having the modified nucleotide sequences of any of the antisense strand/sense strand duplexes of Table 3A or 3B, and further comprises an asialoglycoprotein receptor ligand targeting group.

In some embodiments, an LPA RNAi agent comprises an antisense strand and a sense strand having the modified nucleotide sequences of any of the antisense strand/sense strand duplexes of Table 3A or 3B, and further comprises a targeting group selected from the group consisting of (C11-PEG3-NAG3), (C11-PEG3-NAG3), (C6-PEG4-NAG3), (NAG3), (NAG4), (NAG3-AA2), (NAG3-Palm), (NAG13), (NAG18), (NAG24), (NAG25), (NAG25)s, (NAG26), (NAG27) (NAG28) (NAG29) (NAG30) (NAG30)s, (NAG31), (NAG13), (NAG31s), (NAG32), (NAG33), (NAG34), (NAG35), (NAG36), and (NAG37).

In some embodiments, an LPA RNAi agent comprises any of the duplexes of Table 3A or 3B.

In some embodiments, an LPA RNAi agent consists of any of the duplexes of Table 3A or 3B.

In some embodiments, an LPA RNAi agent comprises an antisense strand and a sense strand having the nucleotide sequences AD03460, AD03536, AD03851, AD03853, AD3847, or AD04110.

In some embodiments, an LPA RNAi agent comprises an antisense strand and a sense strand having the nucleotide sequences AD03460, AD03536, AD03851, AD03853, AD3847, or AD04110, and further comprises an asialoglycoprotein receptor ligand targeting group.

In some embodiments, an LPA RNAi agent comprises an antisense strand and a sense strand having the nucleotide sequences AD03460, AD03536, AD03851, AD03853, AD3847, or AD04110, and further comprises a targeting group selected from the group consisting of (C11-PEG3-NAG3), (C11-PEG3-NAG3), (C6-PEG4-NAG3), (NAG 3), (NAG4), (NAG3-AA2), (NAG3-Palm), (NAG13), (NAG18), (NAG24), (NAG25), (NAG25)s, (NAG26), (NAG27) (NAG28), (NAG29), (NAG30) (NAG30)s, (NAG31), (NAG13), (NAG31s), (NAG32), (NAG33), (NAG34), (NAG35), (NAG36), and (NAG37).

In some embodiments, an LPA RNAi agent comprises an antisense strand and a sense strand having the modified nucleotide sequences AD03460, AD03536, AD03851, AD03853, AD3847, or AD04110.

In some embodiments, an LPA RNAi agent comprises an antisense strand and a sense strand having the modified nucleotide sequences AD03460, AD03536, AD03851, AD03853, AD3847, or AD04110, and further comprises an asialoglycoprotein receptor ligand targeting group.

In some embodiments, an LPA RNAi agent comprises an antisense strand and a sense strand having the modified nucleotide sequences AD03460, AD03536, AD03851, AD03853, AD3847, or AD04110, and further comprises a targeting group selected from the group consisting of (C11-PEG3-NAG3), (C11-PEG3-NAG3), (C6-PEG4-NAG3), (NAG3), (NAG4), (NAG3-AA2), (NAG3-Palm), (NAG13), (NAG18), (NAG24), (NAG25), (NAG25)s, (NAG26), (NAG27), (NAG28), (NAG29) (NAG30) (NAG30)s, (NAG31), (NAG13), (NAG31s), (NAG32), (NAG33), (NAG34), (NAG35), (NAG36), and (NAG37).

In some embodiments, an LPA RNAi agent comprises AD03460, AD03536, AD03851, AD03853, AD3847, or AD04110.

In some embodiments, an LPA RNAi agent consists of AD03460, AD03536, AD03851, AD03853, AD3847, or AD04110.

Non-Nucleotide Group

In some embodiments, an LPA RNAi agent contains or is conjugated to one or more non-nucleotide groups including, but not limited to a targeting group, linking group, delivery polymer, or a delivery vehicle. The non-nucleotide group can enhance targeting, delivery or attachment of the RNAi agent. Examples of targeting groups and linking groups are provided in Table 4. The non-nucleotide group can be covalently linked to the 3' and/or 5' end of either the sense strand and/or the antisense strand. In some embodiments, an LPA RNAi agent contains a non-nucleotide group linked to the 3' and/or 5' end of the sense strand. In some embodiments a non-nucleotide group is linked to the 5' end of an LPA RNAi agent sense strand. A non-nucleotide group may linked directly or indirectly to the RNAi agent via a linker/linking group. In some embodiments a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the conjugate. In some embodiments, a non-nucleotide group enhances endocytosis of the RNAi agent.

Targeting Group

A targeting group can be monovalent, divalent, trivalent, tetravalent, or have higher valency. Representative targeting groups include, without limitation, compounds with affinity to cell surface molecule, cell receptor ligands, hapten, antibodies, monoclonal antibodies, antibody fragments, and antibody mimics with affinity to cell surface molecules. In some embodiments, a targeting group is linked to an RNAi agent using a linker, such as a PEG linker or one, two, or three abasic and/or ribitol groups. In some embodiments, a targeting group comprises a galactose cluster.

The LPA RNAi agents described herein may be synthesized having a reactive group, such as an amine group, at the 5'-terminus. The reactive group may be used to subsequently attach a targeting moiety using methods typical in the art.

In some embodiments, a targeting group comprises an asialoglycoprotein receptor ligand. In some embodiments, an asialoglycoprotein receptor ligand includes or consists of one or more galactose derivatives or galactose clusters. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formylgalactosamine, N-acetyl-galactosamine, N-propionyl-galactosamine, N-n-butanoyl-galactosamine, and N-iso-butanoyl-galactos-amine (see for example: Iobst, S. T. and Drickamer, K. J.B.C. 1996, 271, 6686). Galactose derivatives and galactose clusters that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945). Galactose derivatives have been used to target molecules to hepatocytes in vivo through their binding to the asialoglycoprotein receptor (ASGPr) expressed on the surface of hepatocytes. Binding of ASGPr ligands to the ASGPr(s) facilitates cell-specific targeting to hepatocytes and endocytosis of the molecule into hepatocytes. The galactose cluster may be attached to the 3' or 5' end of the RNAi polynucleotide using methods known in the art.

As used herein, a galactose cluster comprises a molecule having two to four terminal galactose derivatives. A terminal galactose derivative is attached to a molecule through its C-1 carbon. In some embodiments, the galactose cluster is a galactose derivative trimer, tri-antennary galactose derivative, or tri-valent galactose derivative. In some embodiments, the galactose cluster is comprises N-acetylgalactosamines (GalNAc). In some embodiments, the galactose cluster comprises a tri-valent N-acetyl-galactosamine. In some embodiments, the galactose cluster is a galactose derivative tetramer, tetra-antennary galactose derivative, or tetra-valent galactose derivative. In some embodiments, the galactose cluster comprises a tetra-valent N-acetyl-galactosamine.

As used herein, a galactose trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, for example, U.S. Pat. No. 5,885,968; Biessen et al. J. Med. Chem. 1995 Vol. 39 p. 1538-1546). In some embodiments, the PEG spacer is a PEG3 spacer. The branch point can be any small molecule which permits attachment of the three galactose derivatives and further permits attachment of the branch point to the RNAi agent. An example of branch point group is a di-lysine or diglutamate. Attachment of the branch point to the RNAi agent can occur through a linker or spacer. In some embodiments, the linker or spacer comprises a flexible hydrophilic spacer, such as, but not limited to: a PEG spacer. In some embodiments, a PEG spacer is a PEG3 spacer (three ethylene units). In other embodiments, the PEG spacer has 1 to 20 ethylene units ($PEG_1$ to $PEG_{20}$). In some embodiments, a galactose derivative comprises an N-acetylgalactosamine (GalNAc or NAG). In some embodiments, the galactose cluster is comprised of a galactose derivative tetramer, which can be, for example, an N-acetyl-galactosamine tetramer.

In some embodiments, pharmaceutical compositions for delivering an LPA RNAi agent to a liver cell in vivo are described. Such pharmaceutical compositions can include, for example, an LPA RNAi agent conjugated to a galactose cluster. In some embodiments, the galactose cluster is comprised of a galactose derivative trimer, which can be, for example, an N-acetyl-galactosamine trimer, or galactose derivative tetramer, which can be, for example, an N-acetyl-galactosamine tetramer.

Targeting groups include, but are not limited to, (Chol-TEG), (TEG-Chol), (C11-PEG3-NAG3), ($C_m$-$PEG_n$-NAG3), ($C_x$-$PEG_z$-NAG3), (NAG3), (NAG4), (NAG3-AA2), (NAG3-Palm), (NAG13), (NAG18), (NAG24), (NAG25), (NAG25)s, (NAG26), (NAG27) (NAG28) (NAG29) (NAG30) (NAG30)s, (NAG31), (NAG13), (NAG31s), (NAG32), (NAG33), (NAG34), (NAG35), (NAG36), and (NAG37).

Linking Group

In some embodiments, a linking group is conjugated to the RNAi agent. The linking group facilitates covalent linkage of the agent to a targeting group or delivery polymer or delivery vehicle. The linking group can be linked to the 3' or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments a linking group is conjugated to the 5' end of an RNAi agent sense strand. Examples of linking groups, include, but are not limited to: Alk-SMPT-C6, Alk-SS-C6, DBCO-TEG, Me-Alk-SS-C6, and C6-SS-Alk-Me, reactive groups such a primary amines and alkynes, alkyl groups, abasic ribose, ribitol, and/or PEG groups.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage may optionally include a spacer that increases the distance between the two joined atoms. A spacer may further add flexibility and/or length to the linkage. Spacers may include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

Linking groups include, but are not limited to, Alkyl, PEG, (C6-$PEG_n$-Alk), ($C_n$-SMPT-Alk), and ($C_n$-SS-Alk-Me).

Any of the LPA RNAi agents listed in Tables 2A and 2B which contains a 3' or 5' targeting group or linking group, may alternatively contain no 3' or 5' targeting group or linking group, or may contain a different 3' or 5' targeting group or linking group including, but not limited to, those depicted in Table 4. Any of the LPA RNAi agent nucleotide sequences listed in Tables 1, 2A and 2B, whether modified or unmodified, may contain 3' or 5' targeting group or linking group, including, but not limited to, those depicted in Table 4. Any of the LPA RNAi agent duplexes listed in Tables 3A and 3B, whether modified or unmodified, may further comprise a targeting group or linking group, including, but not limited to, those depicted in Table 4, and the targeting group or linking group may be attached to the 3' or 5' terminus of either the sense strand or the antisense strand of the LPA RNAi agent duplex.

TABLE 4

Structures representing various modified nucleotides, targeting groups, and linking groups.

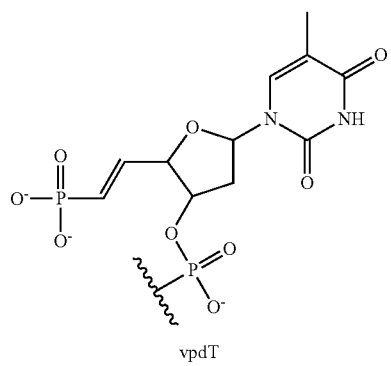

vpdT

TABLE 4-continued
Structures representing various modified nucleotides, targeting groups, and linking groups.
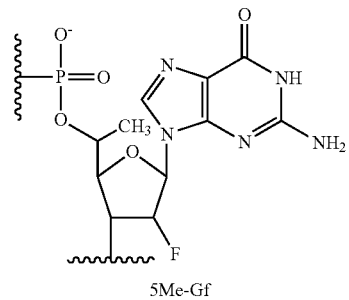
5Me-Gf
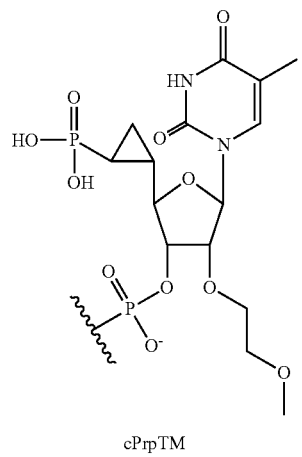 [SMILES: *P(=O)([O-])OC1C(C2CC2P(=O)(O)O)OC(n2cc(C)c(=O)[nH]c2=O)C1OCCOC]
cPrpTM
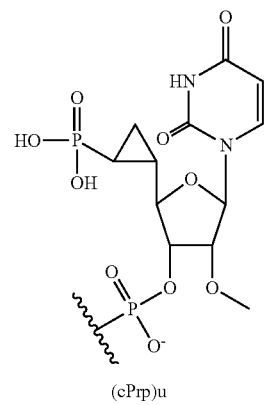
(cPrp)u TABLE 4-continued
Structures representing various modified nucleotides, targeting groups, and linking groups.
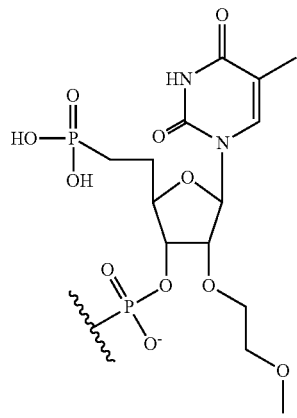
epTM
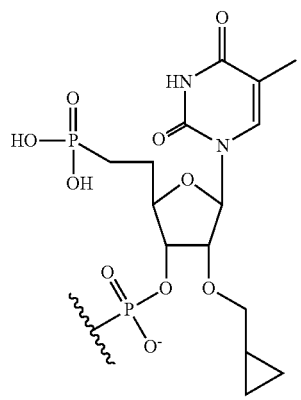
epTcPr
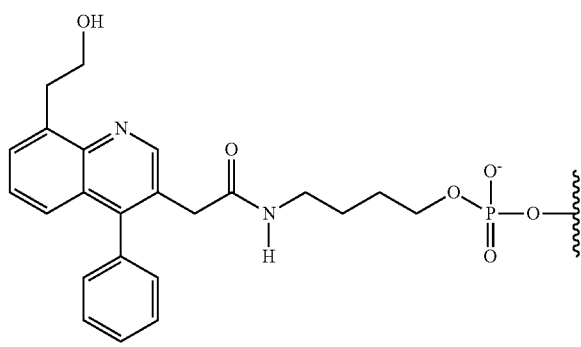
(PAZ)
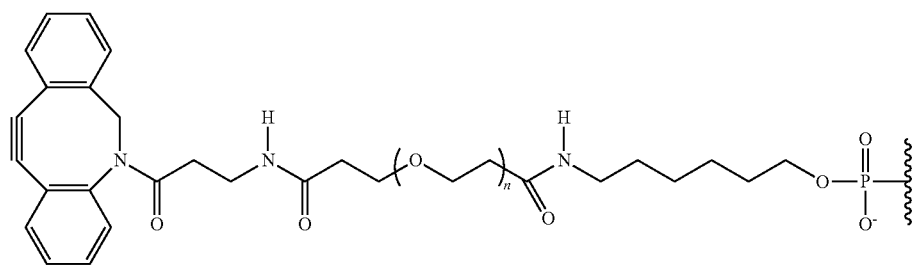
(Alk-PEG$_n$-C6) or (C6-PEG$_n$-Alk), wherein n = 1 = 12
In some embodiments, n = 5 (e.g.., (Alk-PEG5-C6)).

TABLE 4-continued
Structures representing various modified nucleotides, targeting groups, and linking groups.
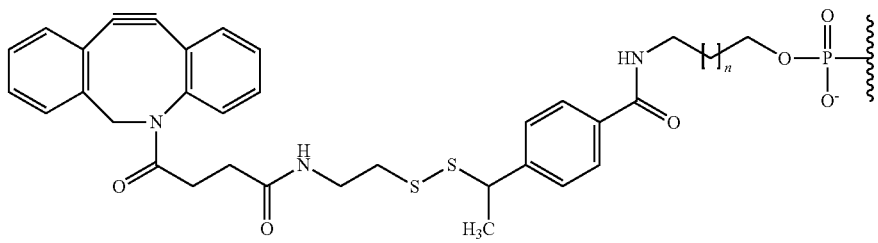
($C_n$-SMPT-Alk) or (Alk-SMPT-$C_n$), wherein n = 1-10,
In some embodiments, n = 4 (e.g., (C6-SMPT-Alk)).
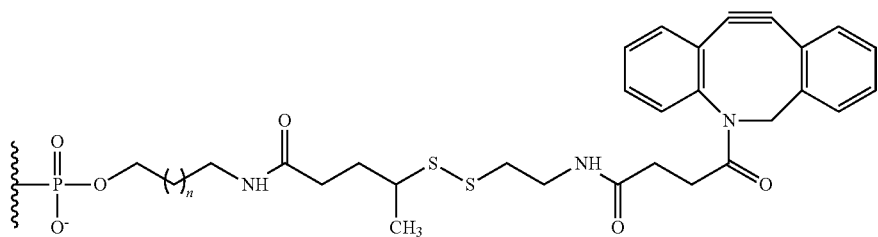
($C_n$-SS-Alk-Me) or ((Me-Alk-SS-$C_n$); wherein n = 1-10
In some embodiments, n = 4 (e.g., (C6-SS-Alk-Me)).
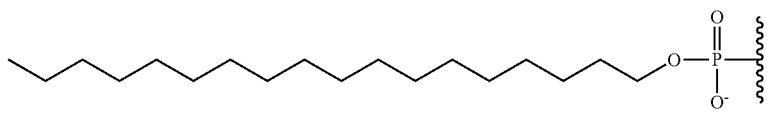
(Stearyl)
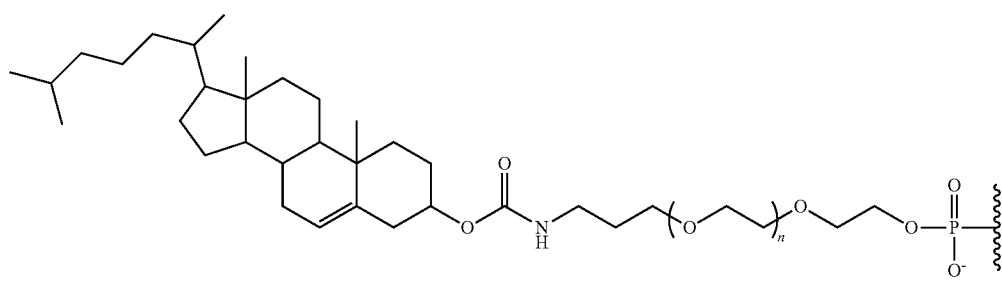
(Chol-TEG), wherein n = 1-10
In some embodiments, n = 2.
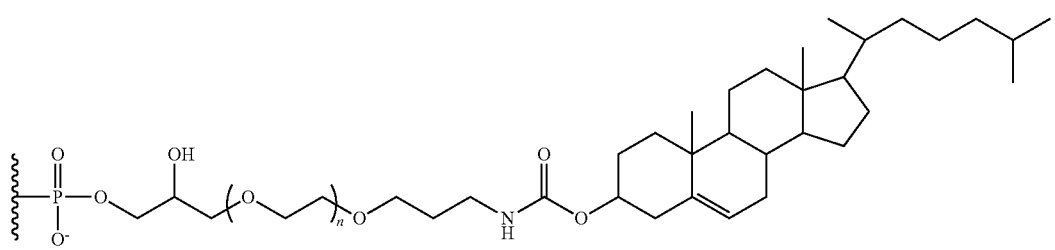
(TEG-Chol), wherein n = 1-10
In some embodiments, n = 3.

TABLE 4-continued
Structures representing various modified nucleotides, targeting groups, and linking groups.
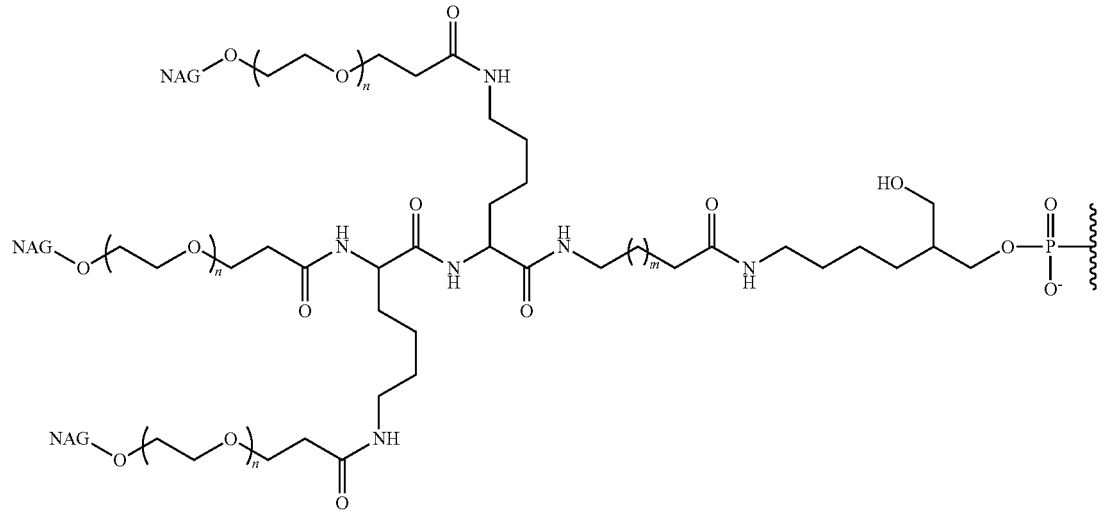
$(NAG3\text{-}PEG_n\text{-}C_m)$ or $(C_m\text{-}PEG_n\text{-}NAG3)$, wherein n = 1-6 and m = 1-12
In some embodiments, n = 3 and m = 9 (e.g., (C11-PEG3-NAG3))
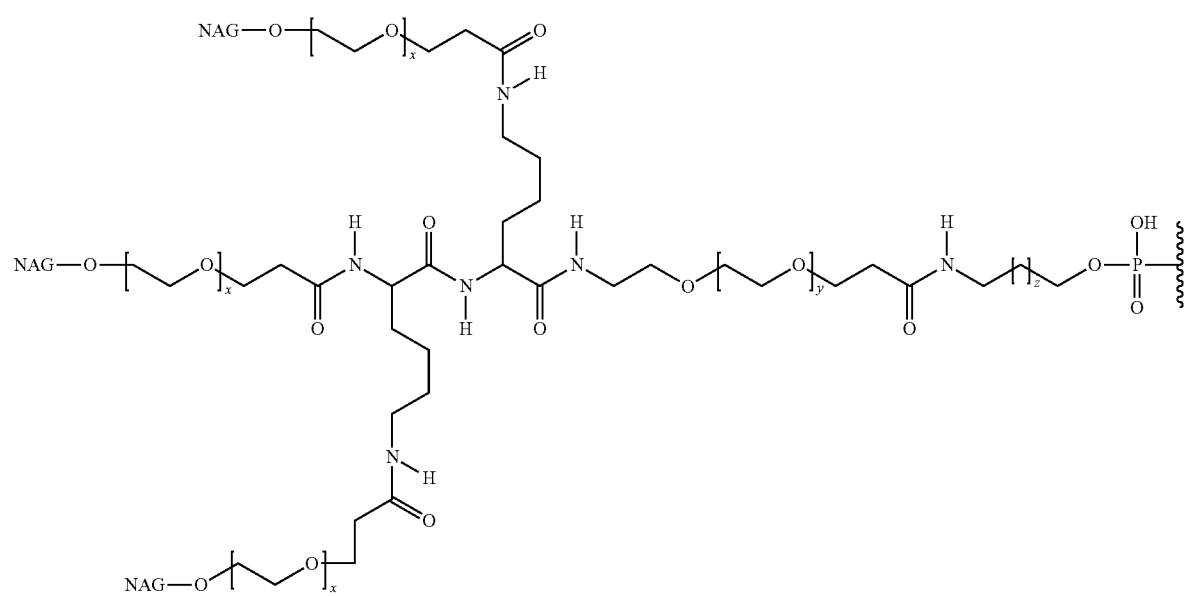
$(C_x\text{-}PEG_z\text{-}NAG3)$, wherein x = 1-10, y - 1-10, and z = 1-10
In some embodiments, x = 3, y = 3, and z = 4 (C6-PEG4-NAG3)
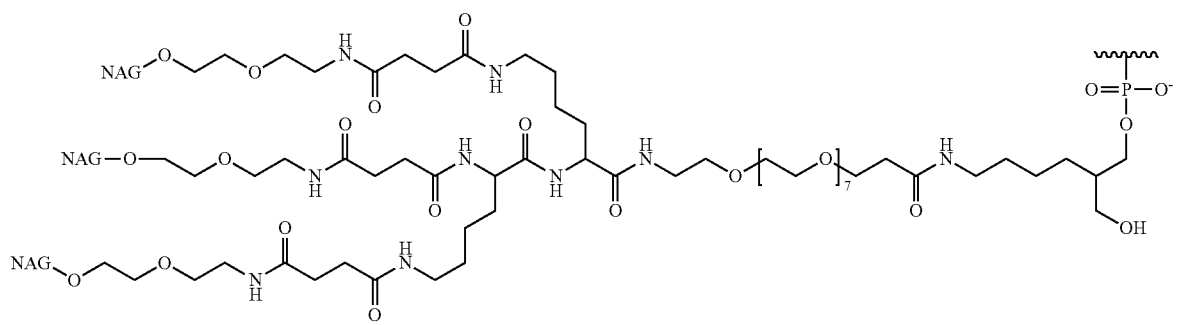
(NAG 3)

TABLE 4-continued
Structures representing various modified nucleotides, targeting groups, and linking groups.
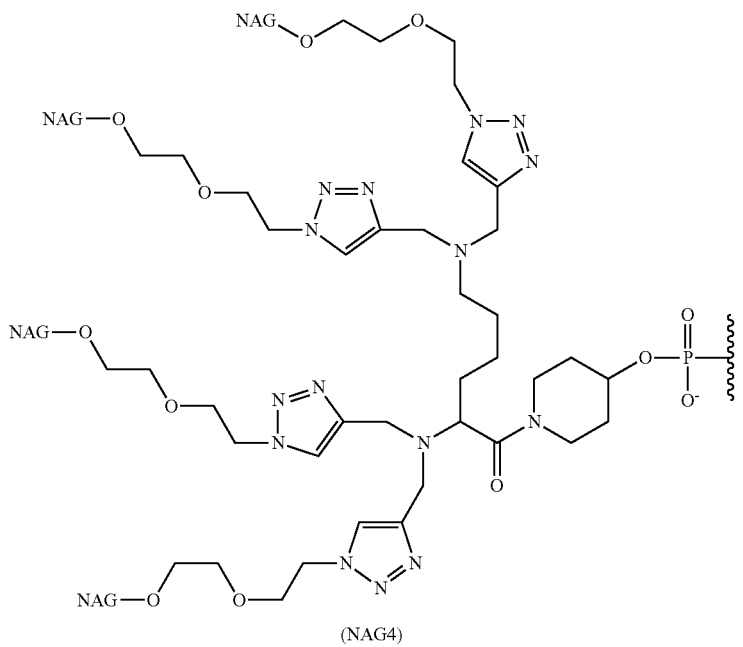
(NAG4)
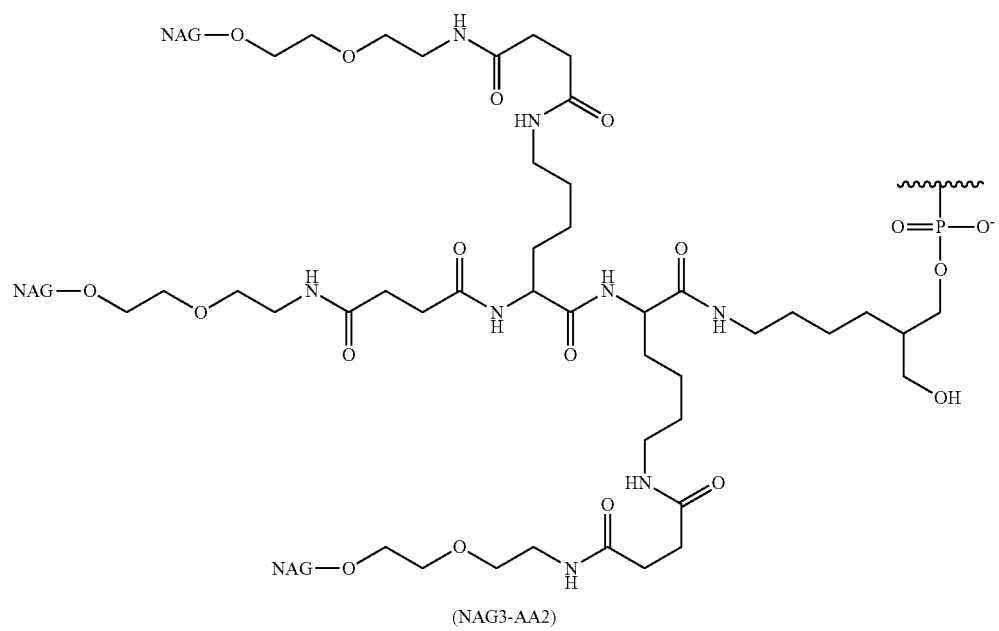
(NAG3-AA2)

TABLE 4-continued
Structures representing various modified nucleotides, targeting groups, and linking groups.
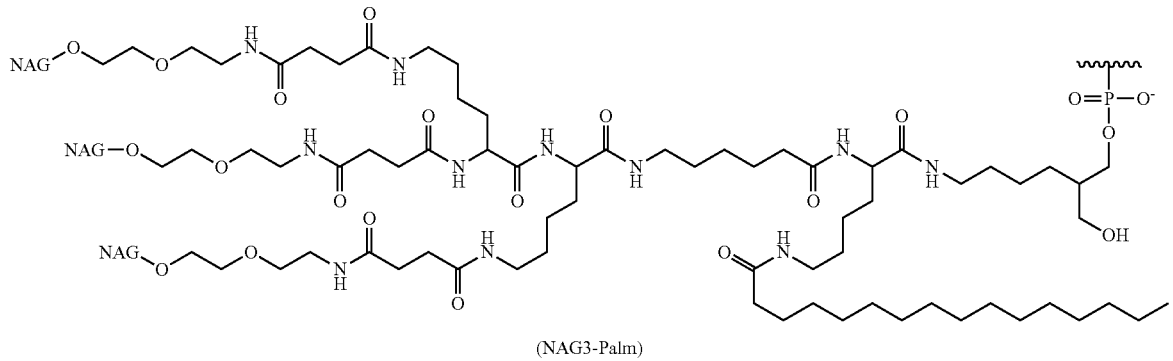
(NAG3-Palm)
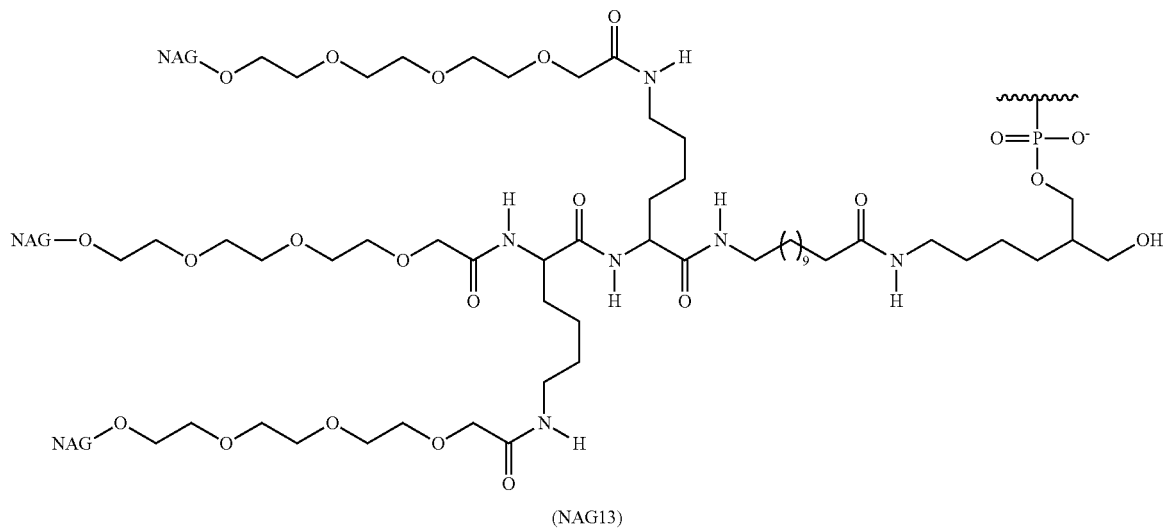
(NAG13)
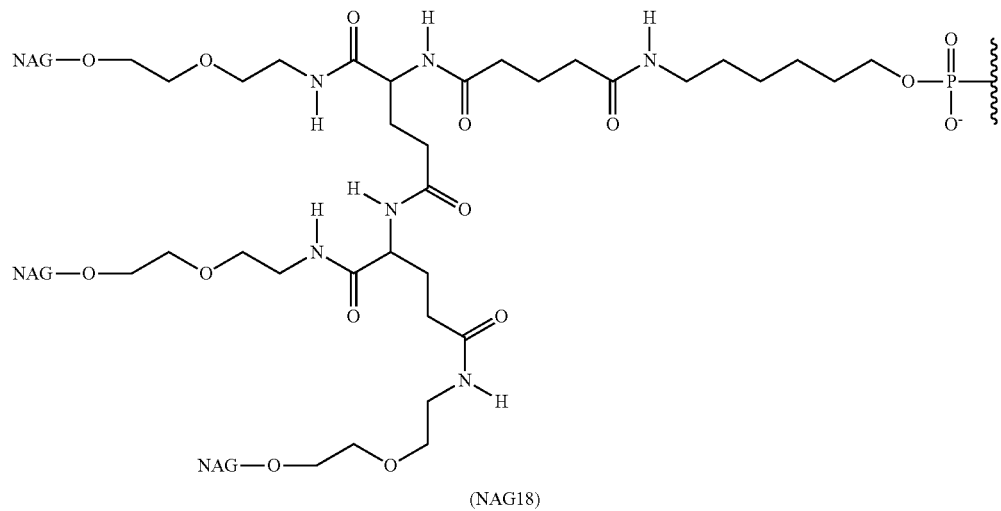
(NAG18)

TABLE 4-continued
Structures representing various modified nucleotides, targeting groups, and linking groups.
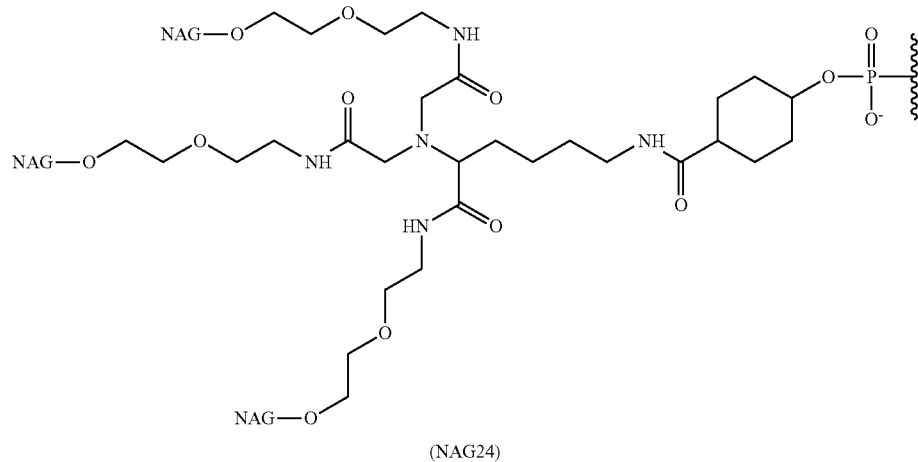
(NAG24)
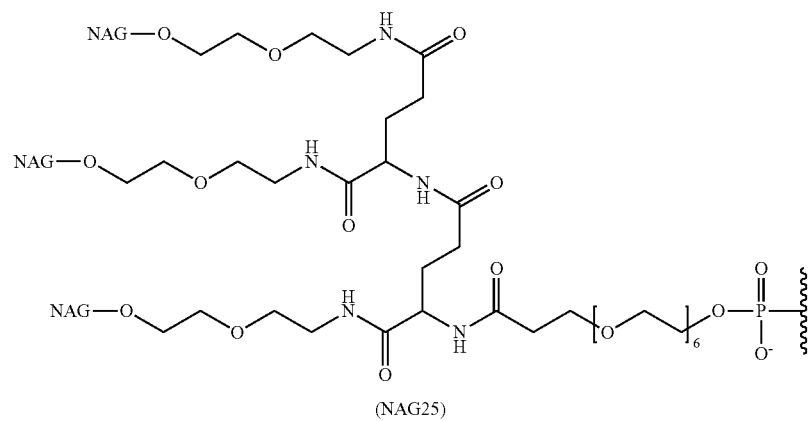
(NAG25)
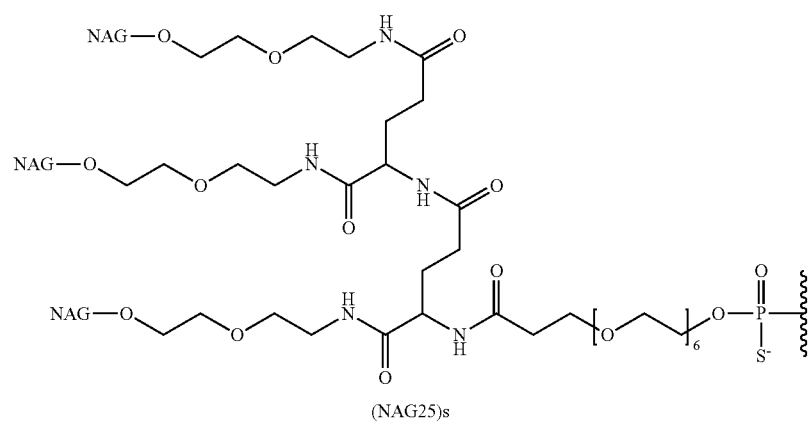
(NAG25)s TABLE 4-continued
Structures representing various modified nucleotides, targeting groups, and linking groups.
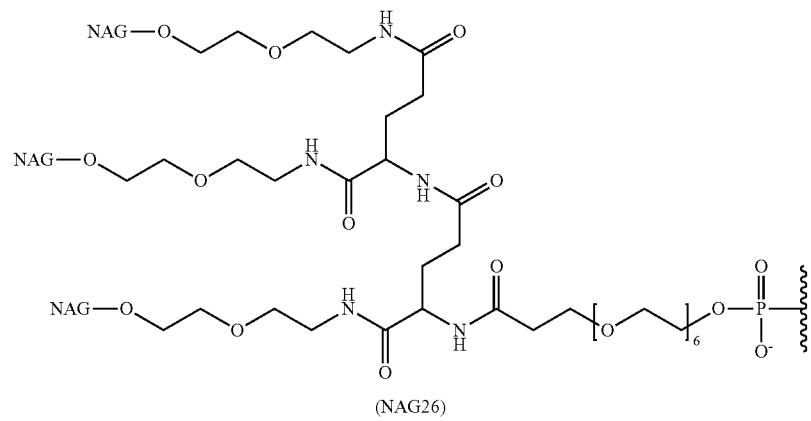
(NAG26)
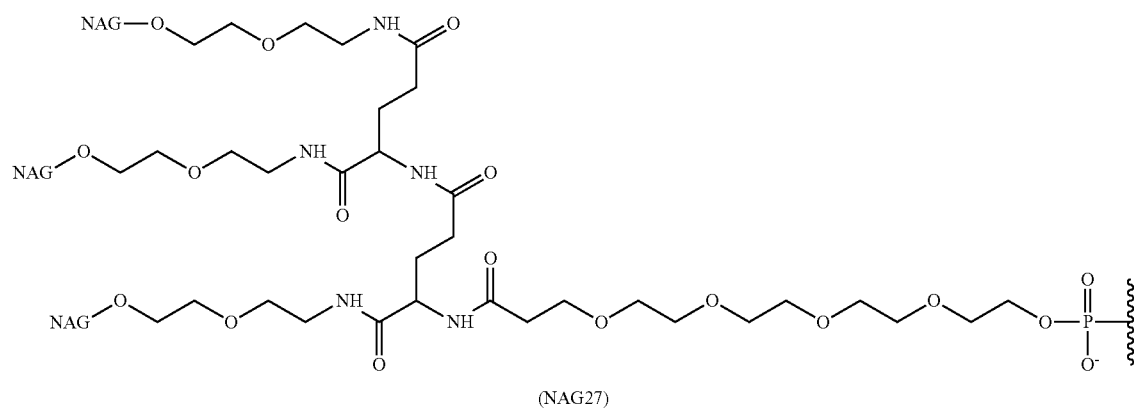
(NAG27)
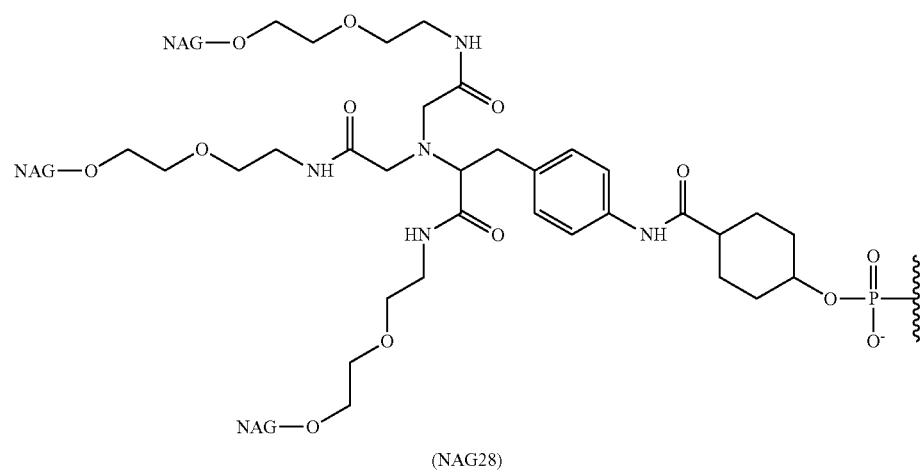
(NAG28)

TABLE 4-continued
Structures representing various modified nucleotides, targeting groups, and linking groups.
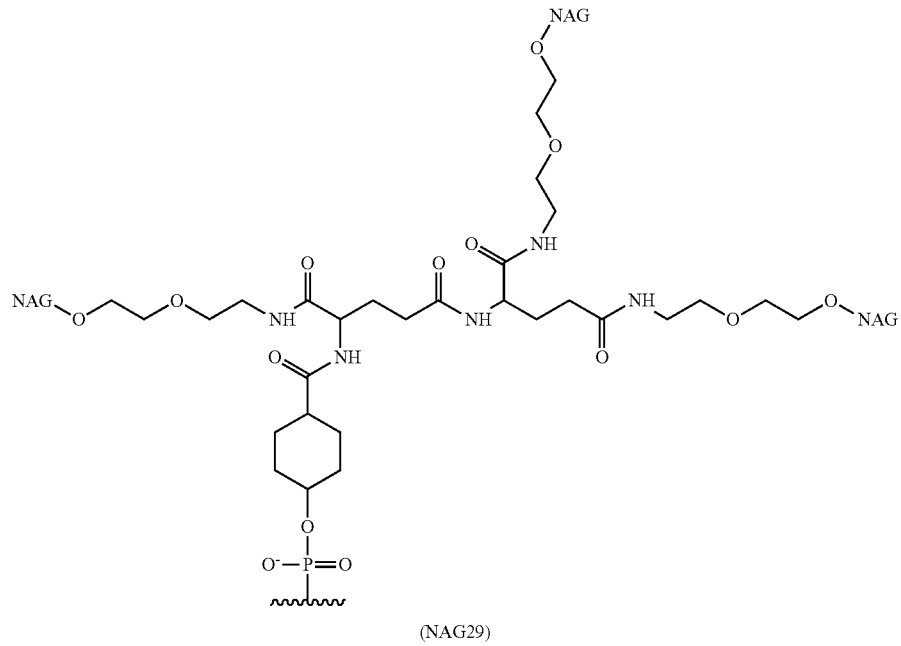
(NAG29)
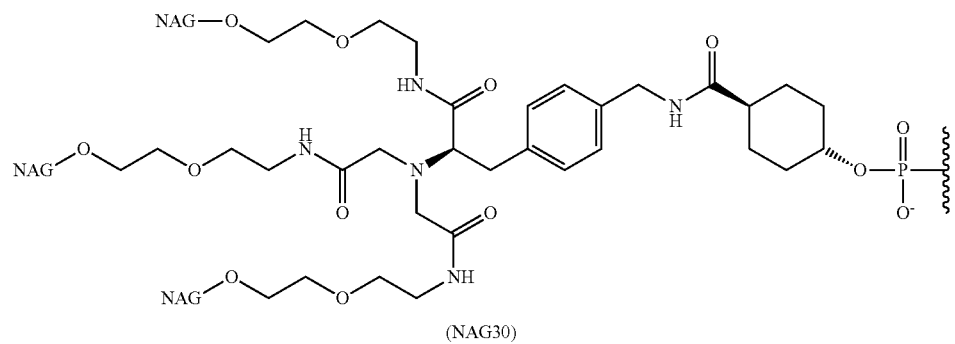
(NAG30)
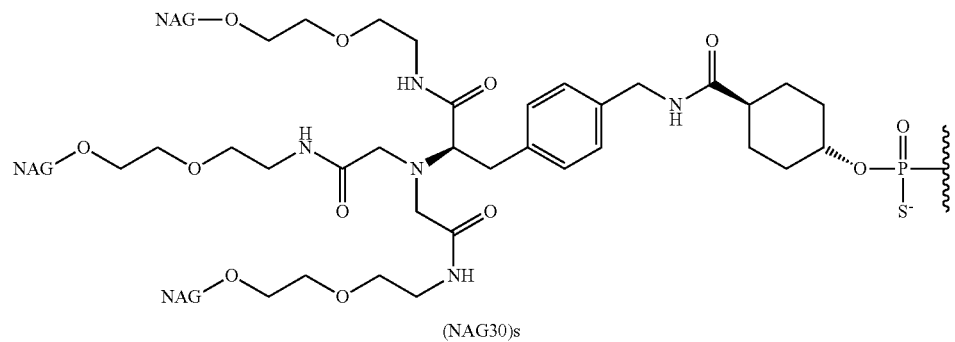
(NAG30)s TABLE 4-continued
Structures representing various modified nucleotides, targeting groups, and linking groups.
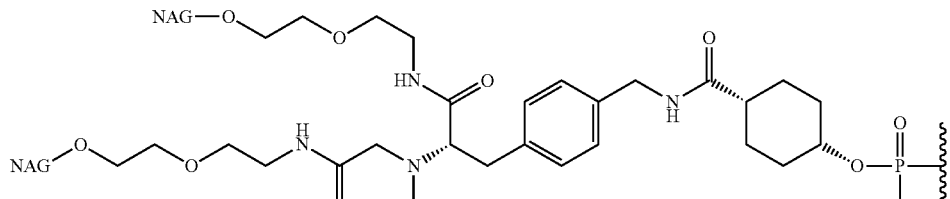
(NAG31)
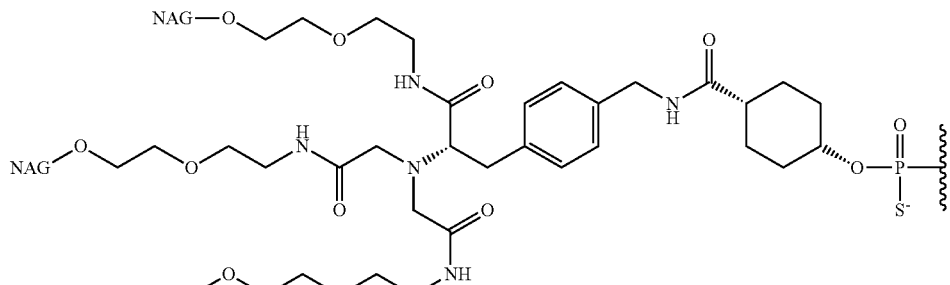
(NAG31)s
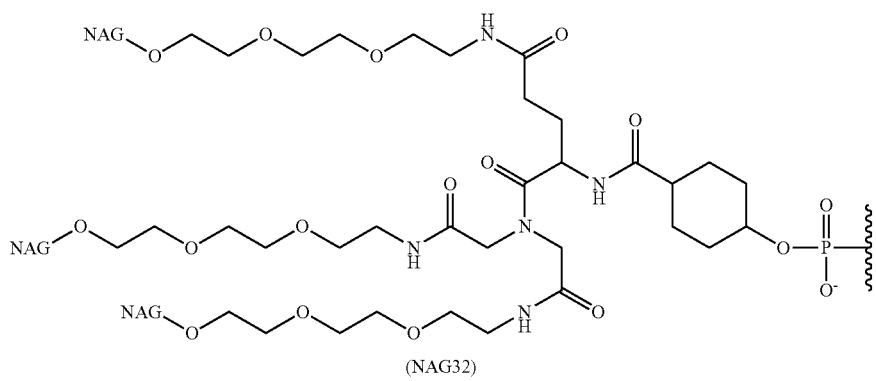
(NAG32)
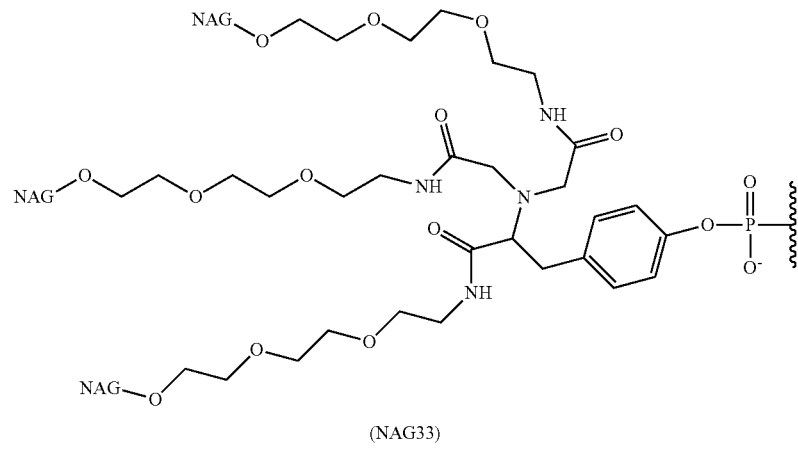
(NAG33)

TABLE 4-continued
Structures representing various modified nucleotides, targeting groups, and linking groups.
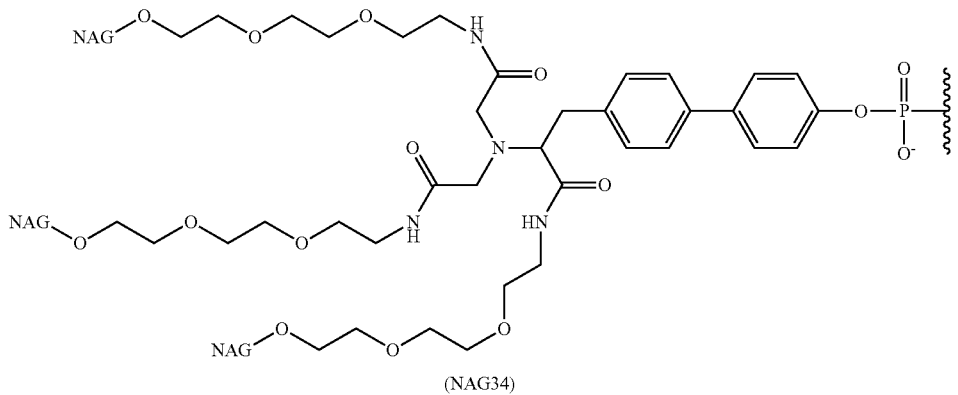
(NAG34)
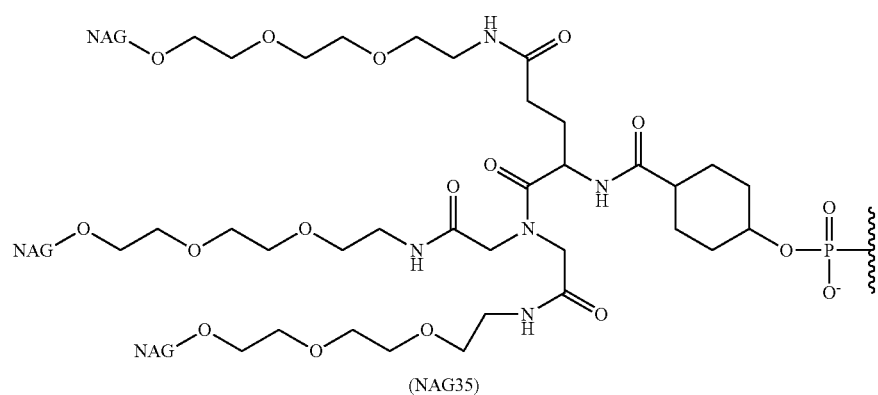
(NAG35)
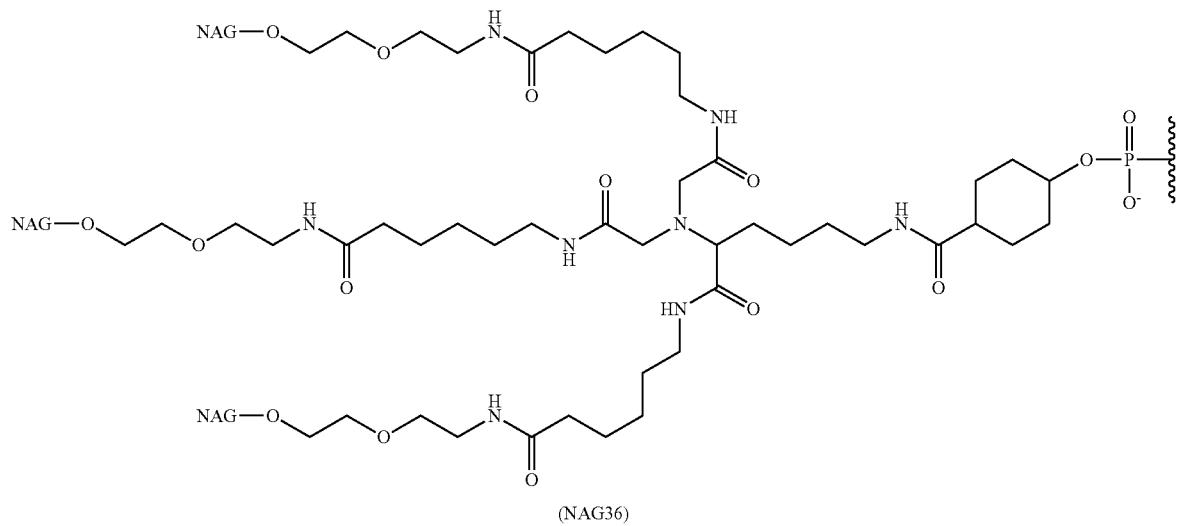
(NAG36)

TABLE 4-continued

Structures representing various modified nucleotides, targeting groups, and linking groups.

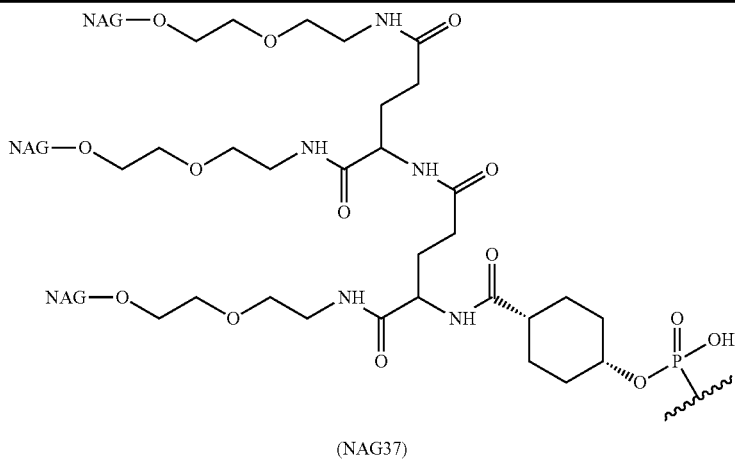

(NAG37)

In each of the above structures, NAG comprises an N-Acetyl-Galactosamine or another ASGPR ligand. Each (NAGx) may be attached to an LPA RNAi agent via a phosphate group (as in (NAG25), (NAG30), and (NAG31)), or a phosphorothioate group, (as is (NAG25)s, (NAG30)s, and (NAG31)s), or another linking group. Alternatively, other linking groups known in the art may be used.

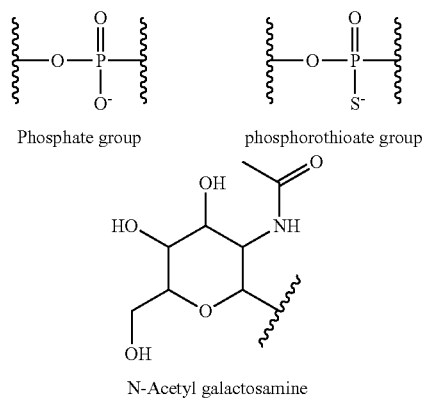

Delivery Vehicles

In some embodiments, a delivery vehicle may be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine.

In some embodiments, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, lipo- somes, micelles, DPCs (see, for example WO 2000/053722, WO 2008/0022309, WO 2011/104169, and WO 2012/083185, WO 2013/032829, WO 2013/158141, each of which is incorporated herein by reference), or other delivery systems available in the art.

Pharmaceutical Compositions

Described herein are methods for delivering LPA RNAi agents to liver cells in a mammal in vivo. In some embodiments, a delivery vehicle may be used. A delivery vehicle is a compound which improves delivery of the RNAi agent to the cell. A delivery vehicle can be, but is not limited to: a polymer, such as an amphipathic polymer, membrane active polymer, a peptide, such as a melittin or melittin-like peptide, a reversibly modified polymer or peptide, or a lipid. In some embodiments, an LPA RNAi agent is linked to a targeting ligand that comprises an asialoglycoprotein ligand. In some embodiments, an LPA RNAi agent is linked to a targeting ligand that comprises or consists of a galactose cluster.

An LPA RNAi agent can be used to inhibit expression of LPA in a cell, group of cells, or a tissue, e.g., in a subject. In some embodiments, an LPA RNAi agent is used to formulate a composition, i.e. a pharmaceutical composition or medicament, for administering to a subject. As used herein, a pharmaceutical composition or medicament comprises a pharmacologically effective amount of at least one of the described LPA RNAi agents and one or more pharmaceutically acceptable excipients. Pharmaceutically acceptable excipients (excipients) are substances other than the Active Pharmaceutical ingredient (API, therapeutic product, e.g., LPA RNAi agent) that have been appropriately evaluated for safety and are intentionally included in the drug delivery system. Excipients do not exert or are not intended to exert a therapeutic effect at the intended dosage. Excipients may act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, dextran, dextrose, diluents, disintegrants, emulsifiers, extenders, fillers, flavors, glidants, humectants, lubricants, oils, polymers, preservatives, saline, salts, solvents, sugars, suspending agents, sustained release matrices, sweeteners, thickening agents, tonicity agents, vehicles, water-repelling agents, and wetting agents.

A pharmaceutical composition can contain other additional components commonly found in pharmaceutical compositions. Such additional components include, but are not limited to: anti-pruritics, astringents, local anesthetics, or anti-inflammatory agents (e.g., antihistamine, diphenhydramine, etc.). It is also envisioned that cells, tissues or isolated organs that express or comprise the herein defined RNAi agents may be used as "pharmaceutical compositions". As used herein, "pharmacologically effective amount," "therapeutically effective amount," or simply "effective amount" refers to that amount of an RNAi agent to produce the intended pharmacological, therapeutic or preventive result.

In some embodiments, a described LPA RNAi agent is combined one or more additional therapeutics or treatments including, but not limited to: a second LPA RNAi agent or other RNAi agent, a small molecule drug, an antibody, an antibody fragment, and/or a vaccine. Examples of additional therapeutics include, but are not limited to, HMg Co-A reductase inhibitors (statins), ezetimibe, PCSK-9 inhibitors, CTEP inhibitors, therapies targeting ANGPTL3, therapies targeting APOC3, and niacin.

The described RNAi agents and pharmaceutical compositions comprising LPA RNAi agents disclosed herein may be packaged or included in a kit, container, pack, or dispenser. The LPA RNAi agents and pharmaceutical compositions comprising said LPA RNAi agents may be packaged in pre-filled syringes or vials.

In some embodiments, pharmaceutical compositions comprising at least one of the described LPA RNAi agents are contemplated. These pharmaceutical compositions are useful in the inhibition of the expression of the LPA gene in a cell, a tissue, or an organism. In some embodiments, the described pharmaceutical compositions are used to treat a subject having a disease, condition, or disorder that would benefit from reduction or inhibition in LPA expression. In some embodiments, the described pharmaceutical compositions are used to treat a subject at risk of developing a disease, condition, or disorder that would benefit from reduction or inhibition in LPA expression. Diseases, conditions, or disorders that would benefit from reduction or inhibition in LPA expression include, but are not limited to: Berger's disease, peripheral artery disease, coronary artery disease, metabolic syndrome, acute coronary syndrome, aortic valve stenosis, aortic valve regurgitation, aortic dissection, retinal artery occlusion, cerebrovascular disease, mesenteric ischemia, superior mesenteric artery occlusion, renal artery stenosis, stable/unstable angina, acute coronary syndrome, heterozygous or homozygous familial hypercholesterolemia, hyperapobetalipoproteinemia, cerebrovascular atherosclerosis, cerebrovascular disease, and venous thrombosis. In some embodiments, the subject is a mammal, including, but not limited to, a human patient.

Cells, tissues, and non-human organisms that include at least one of the LPA RNAi agents described herein is contemplated. The cell, tissue, or non-human organism is made by delivering the RNAi agent to the cell, tissue, or non-human organism by any means available in the art. In some embodiments, the cell is a mammalian cell, including, but not limited to, a human cell. The cell, tissue, or non-human organisms are useful for research or as research tools (e.g., drug testing or diagnoses).

Method of Treatment

In some embodiments, the LPA RNAi agents described herein are used to treat a subject having a disease, condition, or disorder or at risk of having a disease, condition, or disorder that would benefit from reduction or inhibition in LPA expression. Treatment of a subject that would benefit from a reduction and/or inhibition of LPA gene expression includes therapeutic and/or prophylactic treatment. Examples of diseases, conditions, or disorders, include, but not limited to: Berger's disease, peripheral artery disease, coronary artery disease, metabolic syndrome, acute coronary syndrome, aortic valve stenosis, aortic valve regurgitation, aortic dissection, retinal artery occlusion, cerebrovascular disease, mesenteric ischemia, superior mesenteric artery occlusion, renal artery stenosis, stable/unstable angina, acute coronary syndrome, heterozygous or homozygous familial hypercholesterolemia, hyperapobetalipoproteinemia, cerebrovascular atherosclerosis, cerebrovascular disease, and venous thrombosis. In some embodiments, the method comprises administering a composition, such as a pharmaceutical composition, comprising an LPA RNAi agent described herein to a mammal to be treated.

In some embodiments, a therapeutically effective amount of one or more of the described LPA RNAi agents is administered to a subject, thereby inhibiting expression of LPA in the subject (e.g., an amount effective to inhibit expression of LPA in the subject). In some embodiments, one or more of the LPA RNAi agents described herein are used to treat a subject having a disease or disorder that would benefit from reduction or inhibition in LPA expression. In some embodiments, the described LPA RNAi agents are used to treat or prevent at least one symptom in a subject having a disease or disorder that would benefit from reduction or inhibition in LPA expression. The subject is administered a therapeutically effective amount of any one or more of the described RNAi agents thereby treating the symptom. In some embodiments, the subject is administered a prophylactically effective amount of any one or more of the described RNAi agents thereby preventing the at least one symptom.

In some embodiments, an LPA RNAi agent is used to treat or manage a clinical presentation wherein a subject in need of such treatment, prevention, or management is administered a therapeutically or prophylactically effective amount of one or more of the LPA RNAi agents or LPA RNAi agent-containing compositions described herein. In some embodiments, the method comprises administering a composition comprising an LPA RNAi agent described herein to a mammal to be treated.

In some embodiments, the methods further comprise the step of administering a second therapeutic or treatment. In some embodiments, the second therapeutic is another LPA RNAi agent (e.g., a LPA RNAi agent which targets a different sequence within the LPA target). In other embodiments, the second therapeutic can be selected from the group comprising: small molecule drug, antibody, antibody fragment, and vaccine.

The route of administration is the path by which an RNAi agent is brought into contact with the body. In general, methods of administering drugs and nucleic acids for treatment of a subject are well known in the art and can be applied to administration of the compositions described herein. The compounds described herein can be administered via any suitable route in a preparation appropriately tailored to the particular route. Thus, the compounds described herein can be administered by injection, for example, intravenously, intramuscularly, intracutaneously, subcutaneously, or intraperitoneally.

In some embodiments, the LPA RNAi agents or compositions described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with an LPA RNAi agent described herein. For example, delivery can be by local administration, (e.g., direct injection, implantation, or topical administering), systemic administration, or subcutaneous, intravenous, oral, intraperitoneal, or parenteral routes, including intracranial (e.g., intraventricular, intraparenchymal and intrathecal), intramuscular, transdermal, airway (aerosol), nasal, rectal, or topical (including buccal and sublingual) administration, In certain embodiments, the compositions are administered by subcutaneous or intravenous infusion or injection.

In some embodiments, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see e.g., WO 2000/053722, WO 2008/0022309, WO 2011/104169, and WO 2012/083185, each of which is incorporated herein by reference), or other delivery systems available in the art. An LPA RNAi agent can be conjugated to a delivery polymer. In some embodiments, the delivery polymer is a reversibly masked/modified amphipathic membrane active polyamine.

Inhibition of Expression

As used herein, the terms "silence," "reduce," "inhibit," "down-regulate," or "knockdown gene expression," when referring to an LPA gene, mean that the expression of the gene, as measured by the level of RNA transcribed from the gene or the level of polypeptide, protein, or protein subunit translated from the mRNA in a cell, group of cells, or tissue, in which the LPA gene is transcribed, is reduced when the cell, group of cells, or tissue, is treated with the described LPA RNAi agents as compared to a second cell, group of cells, or tissue that has or has not been so treated or compared to the same cell, group of cells, or tissue, prior to administration of the LPA RNAi agent.

In some embodiments, the gene expression level and/or mRNA level of LPA in a subject to whom a described LPA RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, or 98% relative to the subject prior to being administered the LPA RNAi agent or to a subject not receiving the LPA RNAi agent. The gene expression level and/or mRNA level in the subject may be reduced in a cell, group of cells, and/or tissue of the subject. In some embodiments, the protein level of LPA in a subject to whom a described LPA RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, or 98% relative to the subject prior to being administered the LPA RNAi agent or to a subject not receiving the LPA RNAi agent. The protein level in the subject may be reduced in a cell, group of cells, tissue, blood, and/or other fluid of the subject. A reduction in gene expression, mRNA, or protein levels can be assessed by any methods known in the art. Reduction or decrease in LPA mRNA level and/or protein level are collectively referred to herein as a reduction or decrease in LPA or inhibiting or reducing the expression of LPA.

Introducing into a cell, when referring to an RNAi agent, means functionally delivering the RNAi agent into the cell. By functional delivery, it is meant that the RNAi agent is delivered to the cell and has the expected biological activity, (e.g., sequence-specific inhibition of gene expression).

Cells and Tissues and Non-Human Organisms

Cells, tissues, and non-human organisms that include at least one of the LPA RNAi agents described herein is contemplated. The cell, tissue, or non-human organism is made by delivering the RNAi agent to the cell, tissue, or non-human organism.

The above provided embodiments and items are now illustrated with the following, non-limiting examples.

EXAMPLES

Example 1. RNAi Agent Synthesis

A) Synthesis.

LPA RNAi agents were synthesized according to phosphoramidite technology on solid phase used in oligonucleotide synthesis. Depending on the scale either a MerMade96E (Bioautomation) or a MerMade12 (Bioautomation) was used. Syntheses were performed on a solid support made of controlled pore glass (CPG, 500 Å or 600 Å, obtained from Prime Synthesis, Aston, Pa., USA). All DNA, 2'-modified RNA, and UNA phosphoramidites were purchased from Thermo Fisher Scientific (Milwaukee, Wis., USA). Specifically, the following 2'-O-Methyl phosphoramidites were used: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyano-ethyl-N,N-diisopropylamino)phosphoramidite, and 5'-O-dimethoxy-trityl-2'-O-methyl-uridine-3'-O-(2-cyanoethyl-N,N-diisopropylamino)phosphoramidite. The 2'-Deoxy-2'-fluoro-phosphor-amidites carried the same protecting groups as the 2'-O-methyl RNA amidites. The following UNA phosphoramidites were used: 5'-(4,4'-Dimethoxytrityl)-N-benzoyl-2',3'-seco-adenosine, 2'-benzoyl-3'-[(2-cyanoethyl)-(N,N-diisopropyl)]-phosphor-amidite, 5'-(4,4'-Dimethoxytrityl)-N-acetyl-2',3'-seco-cytosine, 2'-benzoyl-3'-[(2-cyanoethyl)-(N,N-diiso-propyl)]-phosphoramidite, 5'-(4,4'-Dimethoxytrityl)-N-isobutyryl-2',3'-seco-guanosine, 2'-benzoyl-3'-[(2-cyanoethyl)-(N,N-diisopropyl)]-phosphoramidite, and 5'-(4,4'-Dimethoxy-trityl)-2',3'-seco-uridine, 2'-benzoyl-3'-[(2-cyanoethyl)-(N,N-diisopropyl)]-phosphoramidite. All amidites were dissolved in anhydrous acetonitrile (50 mM) and molecular sieves (3 Å) were added. In order to introduce the TEG-Cholesterol at the 5'-end of the oligomers, the 1-Dimethoxytrityloxy-3-O—(N-cholesteryl-3-aminopropyl)-triethyleneglycol-gly ceryl-2-O-(2-cyanoethyl)-(N,N,-diisopropyl)-phosphoramidite from Glen Research (Sterling, Va., USA) was employed. The 5'-modifications were introduced without any modification of the synthesis cycle. 5-Benzylthio-1H-tetrazole (BTT, 250 mM in acetonitrile) was used as activator solution. Coupling times were 10 min (RNA), 180 sec (Cholesterol), 90 sec (2'OMe and UNA), and 60 sec (2'F and DNA). In order to introduce phosphorothioate linkages, a 100 mM solution of 3-phenyl 1,2,4-dithiazolin-5-one (POS, obtained from PolyOrg, Inc., Leominster, Mass., USA) in anhydrous Acetonitrile was employed. See Tables 1, 2A, and 2B for specific sequences.

B. Cleavage and Deprotection of Support Bound Oligomer.

After finalization of the solid phase synthesis, the dried solid support was treated with a 1:1 volume solution of 40 wt. % methylamine in water and 28% ammonium hydroxide solution (Aldrich) for two hours at 30° C. The solution was evaporated and the solid residue was reconstituted in water (see below).

C. Purification.

Crude Cholesterol containing oligomers were purified by reverse phase HPLC using a Waters XBridge BEH300 C4 5 u Prep column and a Shimadzu LC-8 system. Buffer A was 100 mM TEAA, pH 7.5 and contained 5% Acetonitrile and buffer B was 100 mM TEAA and contained 95% Acetonitrile. UV traces at 260 nm were recorded. Appropriate fractions were then run on size exclusion HPLC using a GE Healthcare XK 16/40 column packed with Sephadex G-25 medium with a running buffer of 100 mM ammonium bicarbonate, pH 6.7 and 20% Acetonitrile. Other crude oligomers were purified by anionic exchange HPLC using a TKSgel SuperQ-5PW 13 u column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC as described for cholesterol containing oligomers.

D. Annealing.

Complementary strands were mixed by combining equimolar solutions (sense and antisense) in 0.2×PBS (Phosphate-Buffered Saline, 1×, Corning, Cellgro) to form the RNAi agents. This solution was placed into a thermomixer at 70° C., heated to 95° C., held at 95° C. for 5 min, and cooled to room temperature slowly. Some RNAi agents were lyophilized and stored at −15 to −25° C. Duplex concentration was determined by measuring the solution absorbance on a UV-Vis spectrometer in 0.2×PBS. The solution absorbance at 260 nm was then multiplied by a conversion factor and the dilution factor to determine the duplex concentration. Unless otherwise stated, all conversion factor was 0.037 mg/(mL·cm). For some experiments, a conversion factor was calculated from an experimentally determined extinction coefficient.

Example 2. Primary In Vitro Analysis of LPA RNAi Agents

Candidate sequences identified as human and non-human primate cross-reactive by in silico analysis were screened. 108 in silico-identified potential LPA RNAi agents were synthesized and screened for efficacy in vitro in three groups. For screening purposes, the human LPA cDNA sequence (accession # NM 005577.1) was sub-cloned from a commercially available mammalian expression vector (Origene, Rockville, Md.) into a commercially-available, reporter-based screening plasmid, psiCHECK2 (Promega, Madison, Wis.) which generated a *Renilla* luciferase/LPA fusion mRNA. For LPA RNAi agent efficacy in the human background, Hep3B cells, a human hepatocellular carcinoma line, were plated at 10,000 cells per well in 96-well format. Each of the 108 LPA RNAi agents was co-transfected at two or three concentrations (1 nM and 0.1 nM, or 0.02, 0.2 and 2 nM) with 50-100 ng LPA-psiCHECK2 plasmid DNA per well and 0.2 μL LipoFectamine 2000 per well. Gene knockdown was determined by measuring *Renilla* luciferase levels normalized to the levels of constitutively-expressed firefly luciferase, also present on the psiCHECK2 plasmid, using the Dual Luciferase Reporter Assay (Promega, Madison, Wis.) (Tables 5A and 5B).

TABLE 5A

In vitro analyses of LPA RNAi agents, inhibition of LPA expression.

| Duplex | Relative $R_{luc}$-LPA expression | | | |
|---|---|---|---|---|
| | 1 nM | | 0.1 nM | |
| ID# | Average | SD | Average | SD |
| AD00571 | 1.012 | 0.146 | 1.107 | 0.174 |
| AD00572 | 0.776 | 0.062 | 1.075 | 0.089 |
| AD00573 | 0.708 | 0.054 | 0.708 | 0.134 |
| AD00574 | 0.441 | 0.028 | 0.525 | 0.056 |
| AD00575 | 0.242 | 0.038 | 0.365 | 0.035 |
| AD00576 | 0.166 | 0.047 | 0.341 | 0.073 |
| AD00577 | 0.702 | 0.115 | 0.934 | 0.036 |
| AD00578 | 0.272 | 0.008 | 0.599 | 0.200 |
| AD00579 | 0.290 | 0.031 | 0.447 | 0.066 |
| AD00580 | 0.825 | 0.145 | 0.991 | 0.123 |
| AD00581 | 0.654 | 0.095 | 0.986 | 0.127 |
| AD00582 | 0.610 | 0.178 | 0.791 | 0.244 |
| AD00583 | 0.824 | 0.208 | 0.845 | 0.240 |
| AD00584 | 0.800 | 0.150 | 0.683 | 0.077 |
| AD00585 | 0.387 | 0.059 | 0.488 | 0.151 |
| AD00586 | 0.754 | 0.116 | 0.927 | 0.103 |
| AD00587 | 0.921 | 0.074 | 0.923 | 0.052 |
| AD00588 | 0.763 | 0.203 | 0.954 | 0.169 |
| AD00589 | 0.838 | 0.115 | 1.026 | 0.216 |
| AD00590 | 0.959 | 0.091 | 0.991 | 0.285 |
| AD00591 | 0.970 | 0.172 | 0.984 | 0.244 |
| AD00592 | 0.600 | 0.060 | 0.886 | 0.069 |
| AD00593 | 0.555 | 0.097 | 0.883 | 0.130 |
| AD00594 | 0.645 | 0.056 | 0.567 | 0.008 |
| AD00595 | 0.812 | 0.132 | 1.076 | 0.285 |
| AD00596 | 0.658 | 0.116 | 0.787 | 0.153 |
| AD00597 | 0.999 | 0.120 | 1.083 | 0.143 |
| AD00598 | 0.501 | 0.067 | 0.631 | 0.036 |
| AD00599 | 0.890 | 0.098 | 0.871 | 0.143 |
| AD00600 | 0.393 | 0.018 | 0.729 | 0.172 |
| AD00601 | 0.896 | 0.180 | 1.142 | 0.140 |
| AD00602 | 0.653 | 0.134 | 0.955 | 0.062 |
| AD00603 | 0.730 | 0.118 | 0.799 | 0.187 |
| AD00604 | 0.892 | 0.058 | 0.956 | 0.107 |
| AD00605 | 1.006 | 0.193 | 1.006 | 0.146 |
| AD00606 | 0.509 | 0.039 | 0.570 | 0.054 |
| AD00607 | 0.816 | 0.091 | 0.906 | 0.068 |
| AD00608 | 0.883 | 0.111 | 1.158 | 0.054 |
| AD00609 | 0.515 | 0.079 | 0.691 | 0.137 |
| AD00610 | 0.628 | 0.057 | 0.748 | 0.090 |
| AD00611 | 1.320 | 0.066 | 1.116 | 0.046 |
| AD00612 | 1.103 | 0.193 | 1.100 | 0.052 |
| AD00613 | 0.910 | 0.094 | 0.878 | 0.040 |
| AD00614 | 1.101 | 0.111 | 1.097 | 0.043 |
| AD00615 | 1.051 | 0.140 | 0.898 | 0.161 |
| AD00616 | 0.898 | 0.101 | 1.029 | 0.042 |
| AD00617 | 0.715 | 0.023 | 0.802 | 0.150 |
| AD00618 | 0.434 | 0.073 | 0.441 | 0.199 |
| AD00619 | 0.758 | 0.003 | 0.820 | 0.165 |
| AD00620 | 0.984 | 0.124 | 0.926 | 0.080 |
| AD00621 | 0.308 | 0.033 | 0.267 | 0.044 |
| AD00622 | 0.493 | 0.072 | 0.790 | 0.009 |
| AD00623 | 0.641 | 0.081 | 0.599 | 0.014 |
| AD00624 | 0.795 | 0.019 | 0.985 | 0.123 |
| AD00625 | 0.768 | 0.121 | 0.944 | 0.117 |
| AD00626 | 0.981 | 0.081 | 1.036 | 0.036 |
| AD00627 | 0.943 | 0.163 | 0.936 | 0.038 |
| AD00628 | 0.765 | 0.069 | 0.995 | 0.090 |

TABLE 5A-continued

In vitro analyses of LPA RNAi agents, inhibition of LPA expression.

| Duplex ID# | Relative $R_{luc}$-LPA expression | | | |
|---|---|---|---|---|
| | 1 nM | | 0.1 nM | |
| | Average | SD | Average | SD |
| AD00629 | 1.001 | 0.184 | 1.199 | 0.064 |
| AD00630 | 0.963 | 0.149 | 1.154 | 0.141 |
| AD00631 | 0.979 | 0.084 | 1.038 | 0.088 |
| AD00632 | 0.781 | 0.048 | 0.858 | 0.101 |
| AD00633 | 0.817 | 0.072 | 1.027 | 0.143 |
| AD00634 | 0.807 | 0.087 | 0.978 | 0.256 |
| AD00635 | 0.496 | 0.073 | 0.377 | 0.023 |
| AD00636 | 0.615 | 0.102 | 0.748 | 0.072 |
| AD00637 | 0.792 | 0.056 | 1.070 | 0.048 |

TABLE 5B

In vitro analyses of LPA RNAi agents, inhibition of LPA expression.

| Duplex ID# | Relative $R_{luc}$-LPA expression | | | | | |
|---|---|---|---|---|---|---|
| | 2 nM | | 0.2 nM | | 0.02 nM | |
| | Average | SD | Average | SD | Average | SD |
| AD01068 | 0.780 | 0.110 | 0.792 | 0.326 | 0.861 | 0.138 |
| AD01069 | 0.483 | 0.345 | 1.062 | 0.181 | 0.869 | 0.112 |
| AD01070 | 0.747 | 0.441 | 1.010 | 0.015 | 1.015 | 0.319 |
| AD01071 | 1.014 | 0.254 | 0.850 | 0.251 | 0.857 | 0.284 |
| AD01072 | 0.919 | 0.107 | 1.137 | 0.345 | 0.727 | 0.124 |
| AD01073 | 0.539 | 0.224 | 1.066 | 0.195 | 1.180 | 0.356 |
| AD01074 | 0.713 | 0.545 | 0.953 | 0.419 | 0.841 | 0.077 |
| AD01075 | 0.703 | 0.379 | 0.913 | 0.204 | 0.965 | 0.216 |
| AD01076 | 1.145 | 0.485 | 1.027 | 0.287 | 0.647 | 0.154 |
| AD01077 | 0.672 | 0.074 | 1.166 | 0.384 | 0.703 | 0.106 |
| AD01078 | 0.575 | 0.192 | 0.847 | 0.237 | 0.908 | 0.071 |
| AD01079 | 0.863 | 0.673 | 1.093 | 0.187 | 1.004 | 0.086 |
| AD01328 | 0.623 | 0.089 | 1.205 | 0.367 | 1.238 | 0.089 |
| AD01329 | 0.467 | 0.068 | 1.161 | 0.159 | 1.115 | 0.102 |
| AD01330 | 1.158 | 0.124 | 0.920 | 0.143 | 1.156 | 0.107 |
| AD01331 | 1.476 | 0.225 | 1.092 | 0.269 | 1.304 | 0.320 |
| AD01332 | 1.145 | 0.109 | 1.100 | 0.454 | 0.941 | 0.510 |
| AD01333 | 0.829 | 0.011 | 1.382 | 0.252 | 1.338 | 0.303 |
| AD01334 | 0.653 | 0.122 | 1.323 | 0.183 | 1.095 | 0.109 |
| AD01335 | 0.858 | 0.089 | 1.632 | 0.318 | 1.201 | 0.159 |
| AD01336 | 1.019 | 0.081 | 1.724 | 0.353 | 1.008 | 0.072 |
| AD01337 | 0.834 | 0.143 | 1.494 | 0.657 | 1.130 | 0.309 |
| AD01338 | 1.276 | 0.340 | 0.719 | 0.118 | 0.896 | 0.118 |
| AD01339 | 1.240 | 0.298 | 1.114 | 0.287 | 0.960 | 0.104 |
| AD01340 | 1.055 | 0.423 | 1.272 | 0.136 | 1.338 | 0.299 |
| AD01341 | 1.206 | 0.438 | 1.510 | 0.315 | 1.046 | 0.143 |
| AD01342 | 1.243 | 0.324 | 1.137 | 0.298 | 1.159 | 0.047 |
| AD01343 | 1.113 | 0.140 | 1.045 | 0.151 | 1.108 | 0.094 |
| AD01344 | 0.931 | 0.182 | 1.317 | 0.244 | 1.328 | 0.037 |
| AD01345 | 0.795 | 0.233 | 0.799 | 0.032 | 1.418 | 0.184 |
| AD01346 | 1.095 | 0.224 | 1.045 | 0.073 | 1.465 | 0.109 |
| AD01347 | 1.122 | 0.021 | 1.209 | 0.161 | 1.153 | 0.159 |
| AD01348 | 1.022 | 0.068 | 1.228 | 0.244 | 1.097 | 0.049 |
| AD01349 | 0.934 | 0.151 | 1.217 | 0.080 | 1.068 | 0.149 |
| AD01350 | 0.871 | 0.295 | 1.318 | 0.225 | 0.942 | 0.395 |
| AD01351 | 1.414 | 0.065 | 1.121 | 0.180 | 1.029 | 0.049 |
| AD01352 | 0.868 | 0.088 | 1.024 | 0.385 | 1.049 | 0.176 |
| AD01353 | 1.150 | 0.478 | 1.164 | 0.276 | 0.898 | 0.175 |
| AD01354 | 0.999 | 0.119 | 1.378 | 0.292 | 1.507 | 0.289 |
| AD01355 | 0.943 | 0.092 | 1.066 | 0.268 | 1.411 | 0.113 |
| AD01356 | 1.116 | 0.351 | 1.072 | 0.196 | 1.000 | 0.145 |

TABLE 5C

In vitro analyses of 10 mM LPA RNAi agents, inhibition of LPA expression.

| Duplex No. | LPA levels |
|---|---|
| AD01803 | 0.77 ± 0.06 |
| AD01805 | 0.77 ± 0.02 |
| AD01806 | 1.01 ± 0.02 |
| AD01807 | 0.97 ± 0.09 |
| AD01808 | 0.78 ± 0.12 |
| AD01809 | 1.06 ± 0.13 |
| AD01810 | 1.06 ± 0.05 |
| AD01811 | 0.86 ± 0.05 |
| AD01812 | 1.08 ± 0.04 |
| AD01813 | 0.99 ± 0.13 |
| AD01814 | 0.57 ± 0.05 |
| AD01815 | 0.65 ± 0.00 |
| AD01816 | 0.84 ± 0.08 |
| AD01817 | 0.75 ± 0.10 |
| AD01818 | 0.94 ± 0.07 |
| AD01819 | 1.21 ± 0.08 |
| AD01820 | 1.22 ± 0.12 |
| AD01821 | 1.16 ± 0.01 |
| AD01822 | 1.22 ± 0.04 |
| AD01823 | 0.91 ± 0.05 |
| AD01824 | 1.22 ± 0.13 |
| AD01825 | 1.25 ± 0.05 |
| AD01826 | 1.18 ± 0.15 |
| AD01827 | 1.23 ± 0.07 |
| AD01828 | 1.02 ± 0.09 |
| AD01829 | 1.05 ± 0.07 |
| AD01830 | 1.00 ± 0.35 |
| AD01831 | 1.02 ± 0.07 |
| AD01832 | 1.04 ± 0.06 |
| AD01896 | 0.71 ± 0.14 |
| AD01897 | 0.87 ± 0.10 |
| AD01898 | 1.16 ± 0.03 |
| AD01899 | 0.79 ± 0.11 |
| AD01900 | 0.82 ± 0.06 |
| AD01901 | 0.54 ± 0.04 |
| AD01902 | 0.62 ± 0.00 |
| AD01903 | 0.66 ± 0.08 |
| AD01912 | 0.59 ± 0.01 |
| AD01913 | 0.60 ± 0.04 |
| AD01914 | 0.50 ± 0.03 |
| AD01915 | 0.58 ± 0.08 |
| AD01916 | 0.49 ± 0.04 |
| AD01917 | 0.53 ± 0.04 |
| AD01918 | 0.47 ± 0.04 |
| AD01919 | 0.60 ± 0.02 |
| AD01920 | 0.60 ± 0.03 |
| AD01921 | 0.59 ± 0.06 |
| AD01922 | 0.50 ± 0.04 |
| AD01923 | 0.59 ± 0.04 |
| AD01924 | 0.50 ± 0.02 |
| AD01925 | 0.54 ± 0.05 |
| AD01926 | 0.52 ± 0.05 |
| AD01927 | 0.57 ± 0.04 |
| AD01928 | 0.50 ± 0.06 |
| AD01929 | 0.55 ± 0.04 |
| AD01930 | 0.54 ± 0.06 |
| AD01931 | 0.54 ± 0.07 |
| AD01932 | 0.51 ± 0.01 |
| AD01933 | 0.56 ± 0.06 |
| AD01934 | 0.52 ± 0.08 |
| AD01935 | 0.58 ± 0.03 |
| AD01936 | 0.53 ± 0.02 |
| AD01937 | 0.57 ± 0.04 |
| AD01938 | 0.58 ± 0.03 |
| AD01939 | 0.65 ± 0.05 |
| AD01940 | 0.49 ± 0.03 |
| AD01941 | 0.57 ± 0.02 |

TABLE 5D

In vitro analyses of 1 mM LPA RNAi agents, inhibition of LPA expression.

| Duplex No. | LPA levels |
|---|---|
| AD01760 | 0.10 ± 0.01 |
| AD01722 | 0.14 ± 0.01 |
| AD01757 | 0.15 ± 0.00 |
| AD01719 | 0.15 ± 0.00 |
| AD01738 | 0.18 ± 0.01 |
| AD01755 | 0.19 ± 0.01 |
| AD01741 | 0.20 ± 0.00 |
| AD01759 | 0.23 ± 0.02 |
| AD01747 | 0.23 ± 0.03 |
| AD01752 | 0.24 ± 0.03 |
| AD01736 | 0.24 ± 0.02 |
| AD02311 | 0.25 ± 0.05 |
| AD02201 | 0.25 ± 0.03 |
| AD01750 | 0.25 ± 0.00 |
| AD01756 | 0.25 ± 0.01 |
| AD02291 | 0.25 ± 0.03 |
| AD02292 | 0.26 ± 0.01 |
| AD02266 | 0.26 ± 0.02 |
| AD01763 | 0.26 ± 0.01 |
| AD02259 | 0.26 ± 0.03 |
| AD02327 | 0.26 ± 0.02 |
| AD02274 | 0.27 ± 0.03 |
| AD02297 | 0.27 ± 0.02 |
| AD02147 | 0.27 ± 0.03 |
| AD02365 | 0.27 ± 0.04 |
| AD02260 | 0.27 ± 0.03 |
| AD02368 | 0.27 ± 0.01 |
| AD02265 | 0.28 ± 0.03 |
| AD02293 | 0.28 ± 0.04 |
| AD02350 | 0.28 ± 0.02 |
| AD02202 | 0.28 ± 0.03 |
| AD02203 | 0.28 ± 0.03 |
| AD02258 | 0.28 ± 0.05 |
| AD02295 | 0.28 ± 0.03 |
| AD02363 | 0.28 ± 0.04 |
| AD02273 | 0.28 ± 0.02 |
| AD02386 | 0.28 ± 0.02 |
| AD02309 | 0.28 ± 0.03 |
| AD02382 | 0.29 ± 0.01 |
| AD02256 | 0.29 ± 0.02 |
| AD02367 | 0.29 ± 0.03 |
| AD02275 | 0.29 ± 0.04 |
| AD02206 | 0.29 ± 0.01 |
| AD02332 | 0.29 ± 0.02 |
| AD01717 | 0.29 ± 0.03 |
| AD02296 | 0.29 ± 0.01 |
| AD02264 | 0.29 ± 0.03 |
| AD02278 | 0.29 ± 0.03 |
| AD02385 | 0.29 ± 0.00 |
| AD02205 | 0.29 ± 0.04 |
| AD02149 | 0.29 ± 0.02 |
| AD02239 | 0.30 ± 0.05 |
| AD01748 | 0.30 ± 0.02 |
| AD02404 | 0.30 ± 0.01 |
| AD01721 | 0.30 ± 0.03 |
| AD02277 | 0.30 ± 0.05 |
| AD02152 | 0.30 ± 0.01 |
| AD02237 | 0.30 ± 0.02 |
| AD02098 | 0.30 ± 0.03 |
| AD02381 | 0.30 ± 0.02 |
| AD02315 | 0.30 ± 0.02 |
| AD02366 | 0.30 ± 0.01 |
| AD02242 | 0.31 ± 0.03 |
| AD02294 | 0.31 ± 0.02 |
| AD02346 | 0.31 ± 0.04 |
| AD02329 | 0.31 ± 0.02 |
| AD02348 | 0.31 ± 0.01 |
| AD01714 | 0.31 ± 0.05 |
| AD01724 | 0.31 ± 0.01 |
| AD02170 | 0.31 ± 0.02 |
| AD02352 | 0.31 ± 0.02 |
| AD02093 | 0.31 ± 0.01 |
| AD02383 | 0.31 ± 0.02 |
| AD02284 | 0.31 ± 0.04 |
| AD02219 | 0.31 ± 0.04 |
| AD02279 | 0.31 ± 0.03 |
| AD02299 | 0.31 ± 0.05 |
| AD01740 | 0.31 ± 0.02 |
| AD02417 | 0.32 ± 0.01 |
| AD02364 | 0.32 ± 0.02 |
| AD02262 | 0.32 ± 0.03 |
| AD02369 | 0.32 ± 0.01 |
| AD01731 | 0.32 ± 0.02 |
| AD02349 | 0.32 ± 0.01 |
| AD02095 | 0.32 ± 0.02 |
| AD02281 | 0.32 ± 0.01 |
| AD02224 | 0.32 ± 0.06 |
| AD02148 | 0.32 ± 0.04 |
| AD01718 | 0.33 ± 0.01 |
| AD02333 | 0.33 ± 0.01 |
| AD02403 | 0.33 ± 0.01 |
| AD02317 | 0.33 ± 0.03 |
| AD02399 | 0.33 ± 0.02 |
| AD02222 | 0.33 ± 0.01 |
| AD02310 | 0.33 ± 0.02 |
| AD01733 | 0.33 ± 0.01 |
| AD02131 | 0.33 ± 0.01 |
| AD02353 | 0.33 ± 0.03 |
| AD02263 | 0.33 ± 0.03 |
| AD02204 | 0.33 ± 0.01 |
| AD02080 | 0.33 ± 0.00 |
| AD02298 | 0.33 ± 0.03 |
| AD01737 | 0.33 ± 0.01 |
| AD02220 | 0.33 ± 0.04 |
| AD02302 | 0.33 ± 0.00 |
| AD02097 | 0.33 ± 0.00 |
| AD02328 | 0.33 ± 0.02 |
| AD02221 | 0.33 ± 0.01 |
| AD02421 | 0.33 ± 0.02 |
| AD02420 | 0.33 ± 0.03 |
| AD02347 | 0.33 ± 0.04 |
| AD02134 | 0.34 ± 0.01 |
| AD02078 | 0.34 ± 0.03 |
| AD02151 | 0.34 ± 0.02 |
| AD02238 | 0.34 ± 0.03 |
| AD02168 | 0.34 ± 0.00 |
| AD02096 | 0.34 ± 0.03 |
| AD01758 | 0.34 ± 0.05 |
| AD02077 | 0.34 ± 0.02 |
| AD02345 | 0.34 ± 0.02 |
| AD02384 | 0.34 ± 0.02 |
| AD02094 | 0.34 ± 0.01 |
| AD02419 | 0.34 ± 0.04 |
| AD02401 | 0.34 ± 0.02 |
| AD02402 | 0.34 ± 0.03 |
| AD01712 | 0.34 ± 0.04 |
| AD02276 | 0.34 ± 0.01 |
| AD02150 | 0.34 ± 0.02 |
| AD02166 | 0.34 ± 0.03 |
| AD02351 | 0.34 ± 0.02 |
| AD02241 | 0.35 ± 0.04 |
| AD02282 | 0.35 ± 0.01 |
| AD02130 | 0.35 ± 0.04 |
| AD01751 | 0.35 ± 0.03 |
| AD02356 | 0.35 ± 0.03 |
| AD02405 | 0.35 ± 0.04 |
| AD02129 | 0.35 ± 0.01 |
| AD02355 | 0.35 ± 0.01 |
| AD02423 | 0.35 ± 0.06 |
| AD02316 | 0.35 ± 0.02 |
| AD02331 | 0.35 ± 0.02 |
| AD02335 | 0.35 ± 0.01 |
| AD02187 | 0.35 ± 0.03 |
| AD02314 | 0.36 ± 0.04 |
| AD02300 | 0.36 ± 0.03 |
| AD02387 | 0.36 ± 0.06 |
| AD02337 | 0.36 ± 0.04 |
| AD01729 | 0.36 ± 0.01 |
| AD02283 | 0.36 ± 0.02 |
| AD02185 | 0.36 ± 0.01 |

TABLE 5D-continued

In vitro analyses of 1 mM LPA RNAi agents, inhibition of LPA expression.

| Duplex No. | LPA levels |
|---|---|
| AD02167 | 0.36 ± 0.01 |
| AD02076 | 0.36 ± 0.04 |
| AD02418 | 0.36 ± 0.01 |
| AD02422 | 0.36 ± 0.03 |
| AD02111 | 0.36 ± 0.02 |
| AD02079 | 0.37 ± 0.02 |
| AD01754 | 0.37 ± 0.04 |
| AD02334 | 0.37 ± 0.02 |
| AD02280 | 0.37 ± 0.05 |
| AD02113 | 0.37 ± 0.03 |
| AD02389 | 0.37 ± 0.03 |
| AD02223 | 0.37 ± 0.04 |
| AD02184 | 0.37 ± 0.02 |
| AD02153 | 0.37 ± 0.02 |
| AD02165 | 0.37 ± 0.02 |
| AD02207 | 0.37 ± 0.01 |
| AD02330 | 0.37 ± 0.01 |
| AD02243 | 0.37 ± 0.02 |
| AD02255 | 0.38 ± 0.02 |
| AD02257 | 0.38 ± 0.00 |
| AD02169 | 0.38 ± 0.02 |
| AD02081 | 0.38 ± 0.00 |
| AD02186 | 0.38 ± 0.02 |
| AD01744 | 0.38 ± 0.03 |
| AD02075 | 0.38 ± 0.01 |
| AD02135 | 0.38 ± 0.03 |
| AD02114 | 0.38 ± 0.04 |
| AD02188 | 0.38 ± 0.04 |
| AD02318 | 0.38 ± 0.02 |
| AD02388 | 0.38 ± 0.02 |
| AD02115 | 0.38 ± 0.04 |
| AD02133 | 0.38 ± 0.00 |
| AD02183 | 0.38 ± 0.04 |
| AD02116 | 0.38 ± 0.02 |
| AD02132 | 0.39 ± 0.03 |
| AD02400 | 0.39 ± 0.02 |
| AD02338 | 0.39 ± 0.04 |
| AD02112 | 0.39 ± 0.01 |
| AD02354 | 0.39 ± 0.05 |
| AD01749 | 0.40 ± 0.06 |
| AD02312 | 0.40 ± 0.02 |
| AD02240 | 0.40 ± 0.00 |
| AD02313 | 0.40 ± 0.03 |
| AD01710 | 0.40 ± 0.05 |
| AD02301 | 0.40 ± 0.05 |
| AD02425 | 0.40 ± 0.04 |
| AD02099 | 0.41 ± 0.04 |
| AD01723 | 0.41 ± 0.04 |
| AD02391 | 0.41 ± 0.03 |
| AD02392 | 0.41 ± 0.05 |
| AD02083 | 0.41 ± 0.01 |
| AD02155 | 0.41 ± 0.02 |
| AD02082 | 0.41 ± 0.01 |
| AD02336 | 0.41 ± 0.01 |
| AD02101 | 0.41 ± 0.02 |
| AD01728 | 0.42 ± 0.01 |
| AD02424 | 0.42 ± 0.04 |
| AD02175 | 0.42 ± 0.02 |
| AD02225 | 0.42 ± 0.05 |
| AD02086 | 0.43 ± 0.02 |
| AD01725 | 0.43 ± 0.06 |
| AD02374 | 0.43 ± 0.03 |
| AD02390 | 0.43 ± 0.04 |
| AD02227 | 0.43 ± 0.02 |
| AD02137 | 0.43 ± 0.06 |
| AD02085 | 0.43 ± 0.01 |
| AD02407 | 0.43 ± 0.03 |
| AD02100 | 0.44 ± 0.04 |
| AD02406 | 0.44 ± 0.04 |
| AD02136 | 0.44 ± 0.02 |
| AD02209 | 0.44 ± 0.03 |
| AD02154 | 0.44 ± 0.02 |
| AD02171 | 0.44 ± 0.01 |
| AD02261 | 0.45 ± 0.02 |
| AD02271 | 0.45 ± 0.00 |
| AD02371 | 0.45 ± 0.03 |
| AD02173 | 0.45 ± 0.07 |
| AD02319 | 0.45 ± 0.01 |
| AD02176 | 0.46 ± 0.01 |
| AD02428 | 0.46 ± 0.02 |
| AD02410 | 0.46 ± 0.01 |
| AD01746 | 0.46 ± 0.05 |
| AD01732 | 0.46 ± 0.02 |
| AD02157 | 0.47 ± 0.02 |
| AD02372 | 0.47 ± 0.03 |
| AD02427 | 0.47 ± 0.02 |
| AD02370 | 0.47 ± 0.01 |
| AD02172 | 0.47 ± 0.04 |
| AD02158 | 0.47 ± 0.02 |
| AD02270 | 0.48 ± 0.04 |
| AD02426 | 0.48 ± 0.04 |
| AD02361 | 0.48 ± 0.04 |
| AD02245 | 0.48 ± 0.02 |
| AD02373 | 0.48 ± 0.01 |
| AD02084 | 0.48 ± 0.05 |
| AD02194 | 0.48 ± 0.03 |
| AD01753 | 0.48 ± 0.06 |
| AD02320 | 0.48 ± 0.03 |
| AD02268 | 0.48 ± 0.05 |
| AD02226 | 0.49 ± 0.01 |
| AD02156 | 0.49 ± 0.01 |
| AD02409 | 0.49 ± 0.03 |
| AD02244 | 0.49 ± 0.02 |
| AD02189 | 0.49 ± 0.06 |
| AD01764 | 0.50 ± 0.02 |
| AD02174 | 0.50 ± 0.04 |
| AD02117 | 0.50 ± 0.01 |
| AD02208 | 0.50 ± 0.05 |
| AD02104 | 0.51 ± 0.03 |
| AD02408 | 0.51 ± 0.06 |
| AD02272 | 0.51 ± 0.04 |
| AD02122 | 0.51 ± 0.06 |
| AD02140 | 0.51 ± 0.04 |
| AD02362 | 0.51 ± 0.04 |
| AD01739 | 0.52 ± 0.04 |
| AD02121 | 0.52 ± 0.06 |
| AD02138 | 0.52 ± 0.04 |
| AD02358 | 0.52 ± 0.02 |
| AD01734 | 0.53 ± 0.06 |
| AD01713 | 0.53 ± 0.04 |
| AD02285 | 0.53 ± 0.03 |
| AD02102 | 0.53 ± 0.07 |
| AD02303 | 0.53 ± 0.03 |
| AD02212 | 0.53 ± 0.01 |
| AD02139 | 0.53 ± 0.03 |
| AD02230 | 0.54 ± 0.08 |
| AD02103 | 0.54 ± 0.04 |
| AD02191 | 0.54 ± 0.03 |
| AD02429 | 0.54 ± 0.02 |
| AD01716 | 0.54 ± 0.09 |
| AD02360 | 0.54 ± 0.02 |
| AD01762 | 0.54 ± 0.01 |
| AD01735 | 0.55 ± 0.07 |
| AD02248 | 0.55 ± 0.05 |
| AD02193 | 0.55 ± 0.01 |
| AD02119 | 0.55 ± 0.01 |
| AD02287 | 0.55 ± 0.02 |
| AD02357 | 0.56 ± 0.01 |
| AD01708 | 0.57 ± 0.06 |
| AD02247 | 0.57 ± 0.06 |
| AD02430 | 0.58 ± 0.07 |
| AD02339 | 0.58 ± 0.03 |
| AD02321 | 0.59 ± 0.03 |
| AD02269 | 0.59 ± 0.02 |
| AD02210 | 0.59 ± 0.04 |
| AD02211 | 0.60 ± 0.02 |
| AD02091 | 0.60 ± 0.03 |
| AD02120 | 0.60 ± 0.07 |
| AD02229 | 0.60 ± 0.03 |
| AD01727 | 0.60 ± 0.02 |

TABLE 5D-continued

In vitro analyses of 1 mM LPA RNAi agents, inhibition of LPA expression.

| Duplex No. | LPA levels |
|---|---|
| AD01730 | 0.60 ± 0.02 |
| AD02190 | 0.60 ± 0.07 |
| AD02411 | 0.60 ± 0.06 |
| AD02322 | 0.61 ± 0.03 |
| AD02433 | 0.61 ± 0.02 |
| AD01761 | 0.62 ± 0.05 |
| AD01720 | 0.62 ± 0.02 |
| AD02228 | 0.62 ± 0.06 |
| AD02393 | 0.62 ± 0.03 |
| AD02359 | 0.62 ± 0.03 |
| AD02323 | 0.62 ± 0.05 |
| AD02118 | 0.63 ± 0.05 |
| AD02286 | 0.63 ± 0.04 |
| AD02087 | 0.63 ± 0.04 |
| AD01715 | 0.63 ± 0.06 |
| AD02192 | 0.63 ± 0.02 |
| AD02431 | 0.64 ± 0.06 |
| AD02340 | 0.64 ± 0.03 |
| AD02432 | 0.64 ± 0.02 |
| AD02089 | 0.65 ± 0.07 |
| AD02267 | 0.65 ± 0.11 |
| AD02246 | 0.65 ± 0.07 |
| AD02325 | 0.65 ± 0.03 |
| AD02343 | 0.66 ± 0.05 |
| AD02375 | 0.66 ± 0.04 |
| AD02288 | 0.66 ± 0.06 |
| AD02088 | 0.66 ± 0.01 |
| AD02413 | 0.66 ± 0.03 |
| AD02377 | 0.67 ± 0.05 |
| AD02528 | 0.67 ± 0.04 |
| AD02434 | 0.67 ± 0.05 |
| AD02304 | 0.67 ± 0.02 |
| AD02090 | 0.68 ± 0.04 |
| AD02161 | 0.68 ± 0.04 |
| AD02324 | 0.68 ± 0.02 |
| AD02177 | 0.69 ± 0.07 |
| AD02179 | 0.69 ± 0.07 |
| AD02527 | 0.69 ± 0.03 |
| AD02305 | 0.69 ± 0.06 |
| AD02092 | 0.70 ± 0.02 |
| AD02535 | 0.70 ± 0.10 |
| AD02376 | 0.71 ± 0.04 |
| AD01743 | 0.71 ± 0.02 |
| AD02289 | 0.71 ± 0.04 |
| AD02530 | 0.71 ± 0.06 |
| AD01709 | 0.71 ± 0.12 |
| AD02249 | 0.71 ± 0.06 |
| AD02534 | 0.71 ± 0.03 |
| AD02213 | 0.71 ± 0.02 |
| AD02529 | 0.71 ± 0.03 |
| AD01711 | 0.71 ± 0.06 |
| AD02341 | 0.72 ± 0.06 |
| AD02233 | 0.72 ± 0.06 |
| AD02342 | 0.73 ± 0.04 |
| AD02395 | 0.73 ± 0.06 |
| AD02306 | 0.73 ± 0.09 |
| AD02344 | 0.73 ± 0.04 |
| AD02145 | 0.74 ± 0.09 |
| AD02326 | 0.74 ± 0.06 |
| AD02414 | 0.74 ± 0.04 |
| AD02379 | 0.74 ± 0.06 |
| AD02532 | 0.75 ± 0.04 |
| AD02178 | 0.75 ± 0.11 |
| AD02195 | 0.75 ± 0.05 |
| AD02123 | 0.76 ± 0.07 |
| AD02164 | 0.77 ± 0.09 |
| AD01726 | 0.77 ± 0.01 |
| AD02231 | 0.77 ± 0.05 |
| AD02180 | 0.77 ± 0.04 |
| AD02412 | 0.77 ± 0.05 |
| AD02251 | 0.77 ± 0.02 |
| AD02396 | 0.78 ± 0.13 |
| AD02160 | 0.78 ± 0.04 |
| AD02533 | 0.78 ± 0.05 |
| AD02290 | 0.78 ± 0.03 |
| AD02378 | 0.78 ± 0.07 |
| AD02394 | 0.79 ± 0.04 |
| AD02415 | 0.79 ± 0.05 |
| AD02181 | 0.79 ± 0.08 |
| AD02492 | 0.79 ± 0.06 |
| AD02397 | 0.79 ± 0.05 |
| AD02398 | 0.79 ± 0.09 |
| AD02416 | 0.79 ± 0.04 |
| AD02144 | 0.79 ± 0.09 |
| AD02531 | 0.79 ± 0.06 |
| AD02489 | 0.80 ± 0.04 |
| AD02307 | 0.80 ± 0.10 |
| AD02308 | 0.80 ± 0.11 |
| AD02182 | 0.80 ± 0.08 |
| AD02198 | 0.80 ± 0.11 |
| AD02199 | 0.80 ± 0.10 |
| AD02200 | 0.80 ± 0.06 |
| AD02125 | 0.81 ± 0.06 |
| AD02141 | 0.81 ± 0.01 |
| AD02516 | 0.81 ± 0.06 |
| AD02127 | 0.81 ± 0.06 |
| AD02380 | 0.81 ± 0.03 |
| AD02124 | 0.81 ± 0.05 |
| AD02197 | 0.81 ± 0.02 |
| AD02159 | 0.81 ± 0.09 |
| AD02485 | 0.82 ± 0.04 |
| AD02142 | 0.82 ± 0.08 |
| AD02126 | 0.82 ± 0.08 |
| AD02254 | 0.82 ± 0.10 |
| AD02232 | 0.82 ± 0.04 |
| AD02146 | 0.82 ± 0.04 |
| AD02490 | 0.82 ± 0.03 |
| AD01745 | 0.82 ± 0.09 |
| AD02162 | 0.83 ± 0.04 |
| AD02471 | 0.83 ± 0.11 |
| AD02487 | 0.83 ± 0.09 |
| AD02523 | 0.83 ± 0.10 |
| AD02483 | 0.83 ± 0.03 |
| AD02128 | 0.84 ± 0.09 |
| AD02143 | 0.84 ± 0.05 |
| AD02214 | 0.84 ± 0.13 |
| AD02217 | 0.84 ± 0.07 |
| AD02250 | 0.84 ± 0.08 |
| AD02163 | 0.85 ± 0.04 |
| AD02525 | 0.85 ± 0.06 |
| AD02481 | 0.85 ± 0.03 |
| AD02235 | 0.85 ± 0.03 |
| AD02539 | 0.86 ± 0.05 |
| AD02470 | 0.86 ± 0.07 |
| AD02469 | 0.86 ± 0.04 |
| AD02480 | 0.86 ± 0.07 |
| AD02488 | 0.87 ± 0.05 |
| AD02511 | 0.87 ± 0.05 |
| AD02482 | 0.87 ± 0.04 |
| AD02519 | 0.87 ± 0.08 |
| AD02491 | 0.88 ± 0.05 |
| AD02216 | 0.88 ± 0.00 |
| AD02215 | 0.88 ± 0.03 |
| AD02468 | 0.88 ± 0.06 |
| AD02526 | 0.88 ± 0.06 |
| AD02234 | 0.88 ± 0.14 |
| AD02518 | 0.89 ± 0.05 |
| AD02218 | 0.89 ± 0.04 |
| AD02515 | 0.89 ± 0.03 |
| AD02536 | 0.89 ± 0.11 |
| AD02537 | 0.89 ± 0.04 |
| AD02465 | 0.89 ± 0.07 |
| AD02196 | 0.90 ± 0.03 |
| AD02253 | 0.90 ± 0.05 |
| AD02484 | 0.90 ± 0.09 |
| AD02467 | 0.91 ± 0.00 |
| AD02538 | 0.91 ± 0.10 |
| AD02478 | 0.91 ± 0.01 |
| AD02479 | 0.92 ± 0.05 |
| AD02540 | 0.92 ± 0.08 |

TABLE 5D-continued

In vitro analyses of 1 mM LPA RNAi agents, inhibition of LPA expression.

| Duplex No. | LPA levels |
|---|---|
| AD02524 | 0.92 ± 0.03 |
| AD02466 | 0.92 ± 0.05 |
| AD02520 | 0.92 ± 0.06 |
| AD02498 | 0.92 ± 0.06 |
| AD02472 | 0.92 ± 0.05 |
| AD02106 | 0.93 ± 0.08 |
| AD02486 | 0.93 ± 0.02 |
| AD02236 | 0.93 ± 0.04 |
| AD02543 | 0.93 ± 0.12 |
| AD02517 | 0.94 ± 0.05 |
| AD02505 | 0.94 ± 0.10 |
| AD02464 | 0.94 ± 0.06 |
| AD02499 | 0.94 ± 0.16 |
| AD02500 | 0.94 ± 0.05 |
| AD02544 | 0.95 ± 0.07 |
| AD02541 | 0.95 ± 0.15 |
| AD02509 | 0.95 ± 0.09 |
| AD02508 | 0.95 ± 0.10 |
| AD02510 | 0.95 ± 0.03 |
| AD02521 | 0.96 ± 0.16 |
| AD02507 | 0.96 ± 0.03 |
| AD02105 | 0.96 ± 0.09 |
| AD02495 | 0.96 ± 0.05 |
| AD02504 | 0.97 ± 0.04 |
| AD02493 | 0.97 ± 0.06 |
| AD02542 | 0.97 ± 0.06 |
| AD02503 | 0.98 ± 0.05 |
| AD02107 | 0.98 ± 0.05 |
| AD02477 | 0.98 ± 0.06 |
| AD02501 | 0.98 ± 0.07 |
| AD02497 | 0.98 ± 0.05 |
| AD02494 | 0.98 ± 0.13 |
| AD02475 | 1.00 ± 0.07 |
| AD02514 | 1.00 ± 0.00 |
| AD02474 | 1.00 ± 0.03 |
| AD02502 | 1.01 ± 0.01 |
| AD02522 | 1.01 ± 0.04 |
| AD02476 | 1.01 ± 0.09 |
| AD02513 | 1.02 ± 0.03 |
| AD02109 | 1.02 ± 0.06 |
| AD02252 | 1.02 ± 0.08 |
| AD02496 | 1.04 ± 0.05 |
| AD02473 | 1.05 ± 0.04 |
| AD02506 | 1.05 ± 0.05 |
| AD01742 | 1.07 ± 0.24 |
| AD02110 | 1.08 ± 0.07 |
| AD02512 | 1.09 ± 0.17 |
| AD02108 | 1.11 ± 0.04 |

Example 3. LPA RNAi Agent $EC_{50}$ Determination

Ten-point $EC_{50}$ curves were generated using the same cells and transfection conditions, with LPA RNAi agent concentrations ranging from 150 fM-3 nM. $EC_{50}$ were determined using GraphPad Prism software (Table 6).

TABLE 6

$EC_{50}$ values (nM) determined in vitro for the indicated LPA RNAi agents.

| Duplex ID# | $EC_{50}$ (nM) |
|---|---|
| AD00575 | 0.073 |
| AD00576 | 0.038 |
| AD00578 | 0.112 |
| AD00579 | 0.083 |
| AD00621 | 0.100 |
| AD00635 | 0.577 |
| AD01070 | 0.6388 |
| AD01072 | 0.1068 |

TABLE 6-continued $EC_{50}$ values (nM) determined in vitro for the indicated LPA RNAi agents.

| Duplex ID# | $EC_{50}$ (nM) |
|---|---|
| AD01073 | 0.1154 |
| AD01074 | 0.2903 |

Example 4. In Vitro Analysis of Structure Activity Relationship (SAR) Designed LPA RNAi Agents LPA RNAi agent SAR sets (364 sequences based on AD01532 and 351 sequences based on AD01533) were synthesized and screened for efficacy in vitro. For screening purposes, 2756 bp of the human LPA cDNA sequence from KIV-3 to KIV-9 (accession # NM_005577.1) was synthesized and cloned (GeneWiz, South Plainfield, N.J.) into a commercially-available, reporter-based screening plasmid, psiCHECK2 (Promega, Madison, Wis.) which generated a Renilla luciferase/LPA fusion mRNA. For LPA RNAi agent efficacy in the human background, HuH7 cells, a human hepatocellular carcinoma line, were plated at 7500 cells per well in 96-well format. Each of the LPA RNAi agents was co-transfected at two concentrations (1 nM and 0.1 nM, or 10 nM and 1 nM) with 25 ng LPA-psiCHECK2 plasmid DNA per well and 0.24 LipoFectamine 2000 per well. Gene knockdown was determined by measuring Renilla luciferase levels normalized to the levels of constitutively-expressed firefly luciferase, also present on the psiCHECK2 plasmid, using the Dual Luciferase Reporter Assay (Promega, Madison, Wis.) (Tables 7A and 7B).

TABLE 7A

Efficacy screen results of LPA RNAi agents in vitro, as determined by dual-luciferase reporter assay.

| Duplex ID No. | Relative $R_{luc}$-LPA expression | |
|---|---|---|
| | 1 nM | 0.1 nM |
| SD0001 | 0.570 | 0.907 |
| SD0002 | 0.873 | 1.061 |
| SD0003 | 0.955 | 1.020 |
| SD0004 | 0.845 | 1.007 |
| SD0005 | 0.603 | 0.891 |
| SD0006 | 0.551 | 0.780 |
| SD0007 | 0.510 | 0.797 |
| SD0008 | 0.544 | 0.892 |
| SD0009 | 0.564 | 0.878 |
| SD0010 | 0.542 | 1.051 |
| SD0011 | 0.513 | 0.873 |
| SD0012 | 0.533 | 0.963 |
| SD0013 | 0.541 | 0.979 |
| SD0014 | 0.551 | 0.987 |
| SD0015 | 0.488 | 0.951 |
| SD0016 | 0.588 | 0.868 |
| SD0017 | 1.023 | 1.005 |
| SD0018 | 0.866 | 0.965 |
| SD0019 | 0.792 | 1.005 |
| SD0020 | 0.633 | 0.860 |
| SD0021 | 0.572 | 0.797 |
| SD0022 | 0.610 | 0.874 |
| SD0023 | 0.550 | 0.836 |
| SD0024 | 0.597 | 0.859 |
| SD0025 | 0.587 | 0.899 |
| SD0026 | 0.570 | 0.898 |
| SD0027 | 0.580 | 0.825 |
| SD0028 | 0.612 | 0.885 |
| SD0029 | 0.528 | 0.866 |
| SD0030 | 0.657 | 0.825 |

TABLE 7A-continued

Efficacy screen results of LPA RNAi agents in vitro, as determined by dual-luciferase reporter assay.

| Duplex ID No. | Relative $R_{luc}$-LPA expression 1 nM | 0.1 nM |
|---|---|---|
| SD0031 | 0.560 | 0.914 |
| SD0032 | 0.664 | 0.976 |
| SD0033 | 0.787 | 1.035 |
| SD0034 | 0.739 | 1.002 |
| SD0035 | 0.658 | 0.949 |
| SD0036 | 0.554 | 0.896 |
| SD0037 | 0.557 | 0.873 |
| SD0038 | 0.528 | 0.854 |
| SD0039 | 0.511 | 0.847 |
| SD0040 | 0.554 | 0.976 |
| SD0041 | 0.559 | 0.823 |
| SD0042 | 0.496 | 0.825 |
| SD0043 | 0.563 | 0.851 |
| SD0044 | 0.476 | 0.861 |
| SD0045 | 0.542 | 0.841 |
| SD0046 | 0.651 | 0.980 |
| SD0047 | 0.967 | 0.995 |
| SD0048 | 0.694 | 0.936 |
| SD0049 | 0.960 | 0.946 |
| SD0050 | 0.692 | 0.971 |
| SD0051 | 0.611 | 0.905 |
| SD0052 | 0.657 | 0.849 |
| SD0053 | 0.642 | 0.848 |
| SD0054 | 0.598 | 0.852 |
| SD0055 | 0.494 | 0.828 |
| SD0056 | 0.524 | 0.885 |
| SD0057 | 0.582 | 0.816 |
| SD0058 | 0.597 | 0.866 |
| SD0059 | 0.560 | 0.905 |
| SD0060 | 0.594 | 0.849 |
| SD0061 | 0.571 | 1.058 |
| SD0062 | 0.871 | 1.157 |
| SD0063 | 0.969 | 1.138 |
| SD0064 | 0.555 | 1.019 |
| SD0065 | 0.671 | 0.953 |
| SD0066 | 0.561 | 0.951 |
| SD0067 | 0.612 | 0.904 |
| SD0068 | 0.573 | 0.938 |
| SD0069 | 0.574 | 0.975 |
| SD0070 | 0.606 | 1.030 |
| SD0071 | 0.494 | 0.959 |
| SD0072 | 0.557 | 0.892 |
| SD0073 | 0.593 | 0.984 |
| SD0074 | 0.544 | 0.894 |
| SD0075 | 0.552 | 0.937 |
| SD0076 | 0.513 | 1.058 |
| SD0077 | 0.930 | 1.071 |
| SD0078 | 0.984 | 1.006 |
| SD0079 | 0.853 | 1.031 |
| SD0080 | 0.577 | 0.942 |
| SD0081 | 0.595 | 1.044 |
| SD0082 | 0.652 | 0.962 |
| SD0083 | 0.583 | 0.928 |
| SD0084 | 0.540 | 1.049 |
| SD0085 | 0.523 | 0.961 |
| SD0086 | 0.536 | 0.956 |
| SD0087 | 0.586 | 0.987 |
| SD0088 | 0.563 | 0.892 |
| SD0089 | 0.555 | 0.947 |
| SD0090 | 0.599 | 0.928 |
| SD0091 | 0.665 | 0.854 |
| SD0092 | 1.002 | 0.917 |
| SD0093 | 1.047 | 0.880 |
| SD0094 | 0.867 | 0.911 |
| SD0095 | 0.919 | 0.868 |
| SD0096 | 0.666 | 0.887 |
| SD0097 | 0.673 | 0.737 |
| SD0098 | 0.567 | 0.809 |
| SD0099 | 0.604 | 0.909 |
| SD0100 | 0.557 | 0.880 |
| SD0101 | 0.545 | 0.806 |
| SD0102 | 0.728 | 0.900 |
| SD0103 | 0.719 | 0.928 |
| SD0104 | 0.766 | 0.955 |
| SD0105 | 0.965 | 0.927 |
| SD0106 | 1.161 | 1.006 |
| SD0107 | 1.048 | 0.966 |
| SD0108 | 1.066 | 0.985 |
| SD0109 | 1.111 | 0.917 |
| SD0110 | 1.152 | 0.954 |
| SD0111 | 1.045 | 0.944 |
| SD0112 | 1.089 | 1.019 |
| SD0113 | 0.949 | 0.935 |
| SD0114 | 0.875 | 1.033 |
| SD0115 | 1.022 | 1.077 |
| SD0116 | 0.947 | 1.028 |
| SD0117 | 0.946 | 1.021 |
| SD0118 | 0.879 | 0.977 |
| SD0119 | 0.963 | 1.016 |
| SD0120 | 0.967 | 0.948 |
| SD0121 | 0.651 | 0.897 |
| SD0122 | 1.085 | 1.111 |
| SD0123 | 1.153 | 1.052 |
| SD0124 | 0.955 | 0.936 |
| SD0125 | 0.928 | 0.928 |
| SD0126 | 1.033 | 0.933 |
| SD0127 | 0.637 | 0.717 |
| SD0128 | 0.630 | 0.653 |
| SD0129 | 1.052 | 1.192 |
| SD0130 | 1.025 | 1.107 |
| SD0131 | 1.280 | 1.059 |
| SD0132 | 1.094 | 1.024 |
| SD0133 | 1.113 | 1.031 |
| SD0134 | 0.928 | 0.991 |
| SD0135 | 0.804 | 1.023 |
| SD0136 | 1.028 | 1.104 |
| SD0137 | 0.902 | 1.149 |
| SD0138 | 0.942 | 1.015 |
| SD0139 | 0.984 | 1.068 |
| SD0140 | 0.953 | 1.091 |
| SD0141 | 0.925 | 1.022 |
| SD0142 | 0.906 | 0.994 |
| SD0143 | 0.898 | 0.990 |
| SD0144 | 0.858 | 0.972 |
| SD0145 | 0.917 | 0.947 |
| SD0146 | 0.850 | 0.906 |
| SD0147 | 0.933 | 0.995 |
| SD0148 | 0.856 | 0.994 |
| SD0149 | 0.882 | 0.985 |
| SD0150 | 0.810 | 1.002 |
| SD0151 | 0.813 | 0.909 |
| SD0152 | 0.963 | 1.031 |
| SD0153 | 1.058 | 0.936 |
| SD0154 | 0.968 | 0.944 |
| SD0155 | 0.969 | 0.940 |
| SD0156 | 0.933 | 0.807 |
| SD0157 | 0.906 | 0.913 |
| SD0158 | 0.926 | 0.964 |
| SD0159 | 0.805 | 0.850 |
| SD0160 | 0.895 | 0.965 |
| SD0161 | 0.865 | 1.006 |
| SD0162 | 0.935 | 1.029 |
| SD0163 | 0.928 | 0.985 |
| SD0164 | 0.920 | 0.957 |
| SD0165 | 1.039 | 1.110 |
| SD0166 | 1.061 | 1.023 |
| SD0167 | 1.020 | 0.982 |
| SD0168 | 1.053 | 0.989 |
| SD0169 | 1.002 | 1.018 |
| SD0170 | 1.078 | 0.982 |
| SD0171 | 0.838 | 0.923 |
| SD0172 | 1.025 | 0.934 |
| SD0173 | 0.864 | 0.963 |
| SD0174 | 1.020 | 1.043 |

TABLE 7A-continued

Efficacy screen results of LPA RNAi agents in vitro, as determined by dual-luciferase reporter assay.

| Duplex ID No. | Relative $R_{luc}$-LPA expression | |
|---|---|---|
| | 1 nM | 0.1 nM |
| SD0175 | 1.128 | 1.046 |
| SD0176 | 1.009 | 1.110 |
| SD0177 | 0.735 | 0.975 |
| SD0178 | 0.824 | 1.074 |
| SD0179 | 0.690 | 0.895 |
| SD0180 | 0.572 | 0.914 |
| SD0181 | 0.904 | 1.028 |
| SD0182 | 1.176 | 1.093 |
| SD0183 | 1.247 | 1.090 |
| SD0184 | 1.097 | 0.974 |
| SD0185 | 1.045 | 0.985 |
| SD0186 | 0.940 | 0.943 |
| SD0187 | 0.883 | 0.994 |
| SD0188 | ND | ND |
| SD0189 | 0.872 | 0.977 |
| SD0190 | 0.861 | 1.166 |
| SD0191 | 0.779 | 1.044 |
| SD0192 | 0.796 | 1.116 |
| SD0193 | 0.975 | 1.112 |
| SD0194 | 0.876 | 1.058 |
| SD0195 | 0.747 | 0.970 |
| SD0196 | 0.787 | 1.086 |
| SD0197 | 1.276 | 1.127 |
| SD0198 | 1.144 | 1.140 |
| SD0199 | 1.136 | 1.101 |
| SD0200 | 0.814 | 0.911 |
| SD0201 | 0.733 | 0.915 |
| SD0202 | 0.576 | 0.933 |
| SD0203 | 0.593 | 0.824 |
| SD0204 | 0.882 | 1.038 |
| SD0205 | 0.681 | 1.012 |
| SD0206 | 0.600 | 0.927 |
| SD0207 | 0.738 | 0.974 |
| SD0208 | 0.638 | 0.883 |
| SD0209 | 0.641 | 0.878 |
| SD0210 | 0.544 | 0.886 |
| SD0211 | 0.702 | 0.920 |
| SD0212 | 0.704 | 0.854 |
| SD0213 | 0.655 | 0.887 |
| SD0214 | 0.629 | 0.860 |
| SD0215 | 0.598 | 0.850 |
| SD0216 | 0.611 | 0.782 |
| SD0217 | 0.710 | 0.806 |
| SD0218 | 0.738 | 0.758 |
| SD0219 | 0.664 | 0.809 |
| SD0220 | 1.133 | 0.891 |
| SD0221 | 0.940 | 0.914 |
| SD0222 | 0.853 | 0.882 |
| SD0223 | 0.691 | 0.889 |
| SD0224 | 0.997 | 1.033 |
| SD0225 | 0.954 | 0.998 |
| SD0226 | 1.202 | 0.997 |
| SD0227 | 0.948 | 1.017 |
| SD0228 | 0.786 | 0.947 |
| SD0229 | 0.620 | 0.830 |
| SD0230 | 0.840 | 0.972 |
| SD0231 | 0.904 | 0.890 |

TABLE 7B

Efficacy screen results of LPA RNAi agents in vitro, as determined by dual-luciferase reporter assay.

| Duplex ID # | Relative $R_{luc}$-LPA expression | |
|---|---|---|
| | 10 nM | 1 nM |
| SD0232 | 0.659 | 0.699 |
| SD0233 | 0.942 | 1.252 |
| SD0234 | 0.967 | 1.358 |
| SD0235 | 0.910 | 0.890 |
| SD0236 | 0.742 | 0.822 |
| SD0237 | 0.758 | 0.831 |
| SD0238 | 0.700 | 0.737 |
| SD0239 | 0.645 | 0.765 |
| SD0240 | 0.701 | 0.773 |
| SD0241 | 0.770 | 0.821 |
| SD0242 | 0.626 | 0.719 |
| SD0243 | 0.759 | 0.848 |
| SD0244 | 0.798 | 0.953 |
| SD0245 | 0.764 | 0.821 |
| SD0246 | 0.812 | 0.690 |
| SD0247 | 0.786 | 0.844 |
| SD0248 | 1.011 | 1.167 |
| SD0249 | 1.118 | 1.189 |
| SD0250 | 1.021 | 1.239 |
| SD0251 | 1.041 | 1.151 |
| SD0252 | 1.070 | 1.124 |
| SD0253 | 1.044 | 1.131 |
| SD0254 | 0.861 | 0.948 |
| SD0255 | 0.751 | 0.829 |
| SD0256 | 0.931 | 1.037 |
| SD0257 | 1.024 | 1.037 |
| SD0258 | 0.935 | 1.030 |
| SD0259 | 1.089 | 1.081 |
| SD0260 | 0.955 | 1.008 |
| SD0261 | 0.923 | 0.980 |
| SD0262 | 0.908 | 1.107 |
| SD0263 | 1.060 | 1.449 |
| SD0264 | 1.041 | 1.419 |
| SD0265 | 1.065 | 1.373 |
| SD0266 | 0.950 | 1.376 |
| SD0267 | 0.963 | 1.214 |
| SD0268 | 1.023 | 1.299 |
| SD0269 | 0.908 | 1.066 |
| SD0270 | 0.963 | 1.081 |
| SD0271 | 1.088 | 1.189 |
| SD0272 | 0.966 | 1.135 |
| SD0273 | 0.953 | 1.192 |
| SD0274 | 1.049 | 1.217 |
| SD0275 | 1.006 | 1.206 |
| SD0276 | 0.969 | 1.064 |
| SD0277 | 0.686 | 0.796 |
| SD0278 | 0.985 | 1.305 |
| SD0279 | 0.985 | 1.301 |
| SD0280 | 0.978 | 1.237 |
| SD0281 | 1.038 | 1.230 |
| SD0282 | 0.933 | 1.191 |
| SD0283 | 0.930 | 1.152 |
| SD0284 | 0.907 | 1.117 |
| SD0285 | 0.625 | 0.870 |
| SD0286 | 0.984 | 1.056 |
| SD0287 | 0.906 | 0.965 |
| SD0288 | 1.052 | 1.123 |
| SD0289 | 0.997 | 1.215 |
| SD0290 | 0.892 | 1.197 |
| SD0291 | 0.907 | 1.065 |
| SD0292 | 0.689 | 0.862 |
| SD0293 | 0.955 | 1.190 |
| SD0294 | 1.095 | 1.157 |
| SD0295 | 0.851 | 1.004 |
| SD0296 | 1.018 | 1.106 |
| SD0297 | 0.737 | 0.760 |
| SD0298 | 0.790 | 0.828 |
| SD0299 | 0.721 | 0.713 |
| SD0300 | 0.796 | 0.869 |
| SD0301 | 0.781 | 0.841 |
| SD0302 | 0.621 | 0.720 |

TABLE 7B-continued

Efficacy screen results of LPA RNAi agents in vitro, as determined by dual-luciferase reporter assay.

| Duplex ID # | Relative $R_{luc}$-LPA expression | |
|---|---|---|
| | 10 nM | 1 nM |
| SD0303 | 0.684 | 0.852 |
| SD0304 | 0.774 | 0.842 |
| SD0305 | 0.778 | 0.799 |
| SD0306 | 0.718 | 0.793 |
| SD0307 | 0.982 | 0.883 |
| SD0308 | 1.297 | 1.193 |
| SD0309 | 1.123 | 1.208 |
| SD0310 | 0.961 | 1.073 |
| SD0311 | 1.168 | 1.019 |
| SD0312 | 0.923 | 0.824 |
| SD0313 | 0.883 | 0.871 |
| SD0314 | 0.670 | 0.650 |
| SD0315 | 0.988 | 0.958 |
| SD0316 | 0.908 | 0.880 |
| SD0317 | 0.754 | 0.850 |
| SD0318 | 0.963 | 0.944 |
| SD0319 | 0.945 | 0.862 |
| SD0320 | 0.961 | 0.875 |
| SD0321 | 0.841 | 0.797 |
| SD0322 | 0.546 | 0.521 |
| SD0323 | 0.581 | 0.895 |
| SD0324 | 0.692 | 0.900 |
| SD0325 | 0.506 | 0.796 |
| SD0326 | 0.634 | 0.709 |
| SD0327 | 0.522 | 0.592 |
| SD0328 | 0.602 | 0.632 |
| SD0329 | 0.504 | 0.615 |
| SD0330 | 0.445 | 0.601 |
| SD0331 | 0.457 | 0.579 |
| SD0332 | 0.500 | 0.601 |
| SD0333 | 0.447 | 0.618 |
| SD0334 | 0.490 | 0.528 |
| SD0335 | 0.421 | 0.555 |
| SD0336 | 0.488 | 0.533 |
| SD0337 | 1.714 | 0.978 |
| SD0338 | 1.262 | 1.350 |
| SD0339 | 1.259 | 1.357 |
| SD0340 | 0.996 | 1.277 |
| SD0341 | 1.190 | 1.183 |
| SD0342 | 0.818 | 0.923 |
| SD0343 | 0.803 | 0.855 |
| SD0344 | 0.708 | 0.883 |
| SD0345 | 1.132 | 0.901 |
| SD0346 | 0.847 | 0.890 |
| SD0347 | 0.659 | 0.780 |
| SD0348 | 0.730 | 0.945 |
| SD0349 | 0.825 | 0.886 |
| SD0350 | 0.826 | 0.897 |
| SD0351 | 0.730 | 0.842 |
| SD0352 | 0.297 | 0.276 |
| SD0353 | 0.773 | 0.746 |
| SD0354 | 0.663 | 0.722 |
| SD0355 | 0.620 | 0.626 |
| SD0356 | 0.546 | 0.599 |
| SD0357 | 0.298 | 0.411 |
| SD0358 | 0.313 | 0.318 |
| SD0359 | 0.273 | 0.282 |
| SD0360 | 0.256 | 0.257 |
| SD0361 | 0.269 | 0.276 |
| SD0362 | 0.270 | 0.276 |
| SD0363 | 0.350 | 0.272 |
| SD0364 | 0.227 | 0.243 |
| SD0365 | 0.228 | 0.233 |
| SD0366 | 0.264 | 0.241 |
| SD0367 | 0.262 | 0.252 |
| SD0368 | 0.571 | 0.597 |
| SD0369 | 0.539 | 0.531 |
| SD0370 | 0.521 | 0.545 |
| SD0371 | 0.302 | 0.319 |
| SD0372 | 0.353 | 0.335 |
| SD0373 | 0.279 | 0.255 |
| SD0374 | 0.266 | 0.194 |
| SD0375 | 0.246 | 0.238 |
| SD0376 | 0.258 | 0.238 |
| SD0377 | 0.246 | 0.226 |
| SD0378 | 0.237 | 0.226 |
| SD0379 | 0.262 | 0.226 |
| SD0380 | 0.247 | 0.240 |
| SD0381 | 0.639 | 0.657 |
| SD0382 | 0.267 | 0.517 |
| SD0383 | 0.473 | 0.547 |
| SD0384 | 0.456 | 0.563 |
| SD0385 | 0.264 | 0.393 |
| SD0386 | 0.329 | 0.325 |
| SD0387 | 0.186 | 0.231 |
| SD0388 | 0.217 | 0.248 |
| SD0389 | 0.230 | 0.275 |
| SD0390 | 0.210 | 0.270 |
| SD0391 | 0.247 | 0.224 |
| SD0392 | 0.257 | 0.236 |
| SD0393 | 0.252 | 0.253 |
| SD0394 | 0.267 | 0.251 |
| SD0395 | 0.594 | 0.675 |
| SD0396 | 0.511 | 0.678 |
| SD0397 | 0.457 | 0.618 |
| SD0398 | 0.516 | 0.601 |
| SD0399 | 0.261 | 0.389 |
| SD0400 | 0.327 | 0.300 |
| SD0401 | 0.230 | 0.250 |
| SD0402 | 0.231 | 0.260 |
| SD0403 | 0.237 | 0.221 |
| SD0404 | 0.258 | 0.243 |
| SD0405 | 0.253 | 0.246 |
| SD0406 | 0.228 | 0.230 |
| SD0407 | 0.228 | 0.215 |
| SD0408 | 0.247 | 0.255 |
| SD0409 | 0.565 | 0.667 |
| SD0410 | 0.796 | 0.863 |
| SD0411 | 0.633 | 0.646 |
| SD0412 | 0.613 | 0.699 |
| SD0413 | 0.294 | 0.439 |
| SD0414 | 0.416 | 0.310 |
| SD0415 | 0.275 | 0.238 |
| SD0416 | 0.241 | 0.290 |
| SD0417 | 0.257 | 0.284 |
| SD0418 | 0.267 | 0.306 |
| SD0419 | 0.249 | 0.229 |
| SD0420 | 0.243 | 0.240 |
| SD0421 | 0.250 | 0.241 |
| SD0422 | 0.230 | 0.237 |
| SD0423 | 0.555 | 0.684 |
| SD0424 | 0.614 | 0.682 |
| SD0425 | 0.592 | 0.733 |
| SD0426 | 0.604 | 0.699 |
| SD0427 | 0.281 | 0.449 |
| SD0428 | 0.301 | 0.330 |
| SD0429 | 0.230 | 0.261 |
| SD0430 | 0.241 | 0.273 |
| SD0431 | 0.232 | 0.255 |
| SD0432 | 0.247 | 0.288 |
| SD0433 | 0.238 | 0.280 |
| SD0434 | 0.224 | 0.293 |
| SD0435 | 0.249 | 0.240 |
| SD0436 | 0.428 | 0.445 |
| SD0437 | 0.542 | 0.829 |
| SD0438 | 1.106 | 1.048 |
| SD0439 | 0.930 | 1.096 |
| SD0440 | 1.033 | 1.023 |
| SD0441 | 0.630 | 0.657 |
| SD0442 | 0.912 | 0.913 |
| SD0443 | 0.392 | 0.375 |
| SD0444 | 0.552 | 0.441 |

TABLE 7B-continued

Efficacy screen results of LPA RNAi agents in vitro, as determined by dual-luciferase reporter assay.

| Duplex ID # | Relative $R_{luc}$-LPA expression 10 nM | 1 nM |
|---|---|---|
| SD0445 | 0.561 | 0.514 |
| SD0446 | 0.550 | 0.442 |
| SD0447 | 0.415 | 0.362 |
| SD0448 | 0.566 | 0.503 |
| SD0449 | 0.579 | 0.475 |
| SD0450 | 0.463 | 0.424 |
| SD0451 | 0.925 | 0.929 |
| SD0452 | 0.963 | 0.939 |
| SD0453 | 0.967 | 0.952 |
| SD0454 | 0.948 | 0.883 |
| SD0455 | 0.746 | 0.645 |
| SD0456 | 0.840 | 0.860 |
| SD0457 | 0.473 | 0.402 |
| SD0458 | 0.555 | 0.514 |
| SD0459 | 0.566 | 0.472 |
| SD0460 | 0.609 | 0.478 |
| SD0461 | 0.408 | 0.355 |
| SD0462 | 0.630 | 0.532 |
| SD0463 | 0.631 | 0.497 |
| SD0464 | 0.549 | 0.510 |
| SD0465 | 0.966 | 0.809 |
| SD0466 | 0.910 | 0.841 |
| SD0467 | 0.904 | 0.878 |
| SD0468 | 0.999 | 1.009 |
| SD0469 | 0.734 | 0.760 |
| SD0470 | 0.925 | 0.806 |
| SD0471 | 0.559 | 0.482 |
| SD0472 | 0.572 | 0.543 |
| SD0473 | 0.652 | 0.594 |
| SD0474 | 0.621 | 0.598 |
| SD0475 | 0.564 | 0.472 |
| SD0476 | 0.769 | 0.631 |
| SD0477 | 0.734 | 0.613 |
| SD0478 | 0.460 | 0.411 |
| SD0479 | 0.713 | 0.802 |
| SD0480 | 0.883 | 0.892 |
| SD0481 | 0.926 | 0.899 |
| SD0482 | 1.180 | 0.937 |
| SD0483 | 0.805 | 0.986 |
| SD0484 | 0.920 | 1.104 |
| SD0485 | 0.510 | 0.524 |
| SD0486 | 0.626 | 0.598 |
| SD0487 | 0.628 | 0.640 |
| SD0488 | 0.597 | 0.637 |
| SD0489 | 0.482 | 0.486 |
| SD0490 | 0.685 | 0.664 |
| SD0491 | 0.650 | 0.662 |
| SD0492 | 0.454 | 0.490 |
| SD0493 | 1.006 | 1.040 |
| SD0494 | 0.933 | 1.024 |
| SD0495 | 0.927 | 1.016 |
| SD0496 | 0.921 | 1.004 |
| SD0497 | 0.690 | 0.846 |
| SD0498 | 0.970 | 0.913 |
| SD0499 | 0.448 | 0.399 |
| SD0500 | 0.614 | 0.485 |
| SD0501 | 0.609 | 0.521 |
| SD0502 | 0.626 | 0.526 |
| SD0503 | 0.493 | 0.410 |
| SD0504 | 0.727 | 0.551 |
| SD0505 | 0.688 | 0.541 |
| SD0506 | 0.319 | 0.338 |
| SD0507 | 0.927 | 0.897 |
| SD0508 | 0.929 | 0.972 |
| SD0509 | 0.853 | 0.925 |
| SD0510 | 0.755 | 0.935 |
| SD0511 | 0.480 | 0.559 |
| SD0512 | 0.834 | 0.854 |
| SD0513 | 0.440 | 0.323 |
| SD0514 | 0.415 | 0.414 |
| SD0515 | 0.442 | 0.343 |
| SD0516 | 0.422 | 0.341 |
| SD0517 | 0.346 | 0.320 |
| SD0518 | 0.488 | 0.420 |
| SD0519 | 0.435 | 0.390 |
| SD0520 | 0.819 | 0.737 |
| SD0521 | 1.058 | 0.903 |
| SD0522 | 1.088 | 0.933 |
| SD0523 | 1.075 | 0.948 |
| SD0524 | 1.067 | 0.900 |
| SD0525 | 0.917 | 0.858 |
| SD0526 | 1.126 | 1.055 |
| SD0527 | 0.832 | 0.776 |
| SD0528 | 0.980 | 0.886 |
| SD0529 | 1.059 | 0.821 |
| SD0530 | 0.934 | 0.844 |
| SD0531 | 0.832 | 0.883 |
| SD0532 | 0.936 | 0.868 |
| SD0533 | 0.900 | 0.946 |
| SD0534 | 1.012 | 0.984 |
| SD0535 | 1.041 | 1.095 |
| SD0536 | 1.113 | 1.097 |
| SD0537 | 1.125 | 0.957 |
| SD0538 | 1.059 | 1.162 |
| SD0539 | 0.901 | 0.963 |
| SD0540 | 0.900 | 0.924 |
| SD0541 | 1.033 | 0.911 |
| SD0542 | 0.958 | 0.906 |
| SD0543 | 0.870 | 0.816 |
| SD0544 | 1.100 | 0.853 |
| SD0545 | 0.881 | 0.794 |
| SD0546 | 0.897 | 0.813 |
| SD0547 | 1.005 | 0.785 |
| SD0548 | 0.972 | 0.866 |
| SD0549 | 1.019 | 1.121 |
| SD0550 | 0.986 | 1.015 |
| SD0551 | 0.966 | 1.033 |
| SD0552 | 0.893 | 1.028 |
| SD0553 | 0.976 | 0.998 |
| SD0554 | 0.938 | 0.935 |
| SD0555 | 0.886 | 0.875 |
| SD0556 | 1.181 | 1.142 |
| SD0557 | 1.016 | 0.999 |
| SD0558 | 1.026 | 0.968 |
| SD0559 | 0.928 | 0.844 |
| SD0560 | 0.990 | 0.805 |
| SD0561 | 0.836 | 0.791 |
| SD0562 | 1.021 | 0.772 |
| SD0563 | 0.886 | 0.946 |
| SD0564 | 1.194 | 1.254 |
| SD0565 | 1.010 | 1.033 |
| SD0566 | 1.110 | 0.993 |
| SD0567 | 0.995 | 0.895 |
| SD0568 | 0.964 | 0.901 |
| SD0569 | 0.853 | 0.876 |
| SD0570 | 0.832 | 0.860 |
| SD0571 | 1.036 | 0.959 |
| SD0572 | 1.013 | 0.902 |
| SD0573 | 0.948 | 0.793 |
| SD0574 | 0.868 | 0.812 |
| SD0575 | 0.946 | 0.712 |
| SD0576 | 0.922 | 0.774 |
| SD0577 | 0.824 | 0.800 |
| SD0578 | 0.997 | 0.950 |
| SD0579 | 1.048 | 1.143 |
| SD0580 | 1.071 | 0.935 |
| SD0581 | 0.987 | 0.869 |
| SD0582 | 0.946 | 0.816 |
| SD0583 | 0.932 | 0.789 |
| SD0584 | 1.062 | 0.866 |
| SD0585 | 1.155 | 0.891 |
| SD0586 | 0.960 | 0.819 |

TABLE 7B-continued

Efficacy screen results of LPA RNAi agents in vitro, as determined by dual-luciferase reporter assay.

| Duplex ID # | Relative $R_{luc}$-LPA expression 10 nM | 1 nM |
|---|---|---|
| SD0587 | 0.934 | 0.832 |
| SD0588 | 1.033 | 0.781 |
| SD0589 | 0.972 | 0.798 |
| SD0590 | 0.925 | 0.704 |
| SD0591 | 1.061 | 0.915 |
| SD0592 | 1.129 | 0.996 |
| SD0593 | 0.856 | 0.895 |
| SD0594 | 0.840 | 0.956 |
| SD0595 | 0.882 | 0.857 |
| SD0596 | 0.856 | 0.896 |
| SD0597 | 0.869 | 0.697 |
| SD0598 | 0.878 | 0.700 |
| SD0599 | 0.808 | 0.857 |
| SD0600 | 0.856 | 0.823 |
| SD0601 | 0.742 | 0.713 |
| SD0602 | 0.740 | 0.846 |
| SD0603 | 0.808 | 0.816 |
| SD0604 | 0.561 | 0.527 |
| SD0605 | 0.711 | 0.880 |
| SD0606 | 0.852 | 0.922 |
| SD0607 | 0.695 | 0.887 |
| SD0608 | 0.635 | 0.917 |
| SD0609 | 0.655 | 0.874 |
| SD0610 | 0.596 | 0.765 |
| SD0611 | 0.482 | 0.508 |
| SD0612 | 0.629 | 0.578 |
| SD0613 | 0.616 | 0.503 |
| SD0614 | 0.716 | 0.682 |
| SD0615 | 0.570 | 0.491 |
| SD0616 | 0.671 | 0.668 |
| SD0617 | 0.713 | 0.721 |
| SD0618 | 0.819 | 0.862 |
| SD0619 | 0.925 | 0.968 |
| SD0620 | 0.859 | 0.978 |
| SD0621 | 0.923 | 1.075 |
| SD0622 | 0.900 | 0.988 |
| SD0623 | 0.908 | 0.969 |
| SD0624 | 0.775 | 0.889 |
| SD0625 | 0.827 | 0.850 |
| SD0626 | 0.832 | 0.796 |
| SD0627 | 0.916 | 0.796 |
| SD0628 | 0.863 | 0.898 |
| SD0629 | 0.915 | 0.869 |
| SD0630 | 0.893 | 0.856 |
| SD0631 | 0.940 | 0.848 |
| SD0632 | 0.878 | 0.911 |
| SD0633 | 0.934 | 1.074 |
| SD0634 | 0.915 | 1.019 |
| SD0635 | 0.911 | 0.912 |
| SD0636 | 0.852 | 0.911 |
| SD0637 | 0.997 | 0.965 |
| SD0638 | 0.983 | 0.935 |
| SD0639 | 0.806 | 0.823 |
| SD0640 | 0.838 | 0.846 |
| SD0641 | 0.906 | 0.861 |
| SD0642 | 0.740 | 0.836 |
| SD0643 | 0.739 | 0.725 |
| SD0644 | 0.780 | 0.762 |
| SD0645 | 0.739 | 0.819 |
| SD0646 | 0.734 | 0.798 |
| SD0647 | 0.789 | 0.913 |
| SD0648 | 0.707 | 0.946 |
| SD0649 | 0.943 | 1.077 |
| SD0650 | 0.729 | 0.872 |
| SD0651 | 0.666 | 0.879 |
| SD0652 | 0.704 | 0.882 |
| SD0653 | 0.661 | 0.726 |
| SD0654 | 0.751 | 0.881 |
| SD0655 | 0.727 | 0.822 |
| SD0656 | 0.746 | 0.839 |
| SD0657 | 0.849 | 0.842 |
| SD0658 | 0.835 | 0.796 |
| SD0659 | 0.972 | 0.830 |
| SD0660 | 0.772 | 0.672 |
| SD0661 | 0.883 | 0.918 |
| SD0662 | 0.934 | 0.952 |
| SD0663 | 0.974 | 0.891 |
| SD0664 | 0.939 | 0.936 |
| SD0665 | 1.116 | 0.919 |
| SD0666 | 0.924 | 0.954 |
| SD0667 | 0.780 | 0.744 |
| SD0668 | 0.795 | 0.726 |
| SD0669 | 0.819 | 0.754 |
| SD0670 | 0.856 | 0.830 |
| SD0671 | 0.844 | 0.758 |
| SD0672 | 0.978 | 0.952 |
| SD0673 | 0.860 | 0.845 |
| SD0674 | 0.526 | 0.566 |
| SD0675 | 0.661 | 0.961 |
| SD0676 | 0.690 | 0.916 |
| SD0677 | 0.672 | 0.939 |
| SD0678 | 0.821 | 0.973 |
| SD0679 | 0.943 | 0.952 |
| SD0680 | 1.018 | 0.991 |
| SD0681 | 0.561 | 0.580 |
| SD0682 | 0.777 | 0.688 |
| SD0683 | 0.654 | 0.639 |
| SD0684 | 0.691 | 0.622 |
| SD0685 | 0.518 | 0.555 |
| SD0686 | 0.661 | 0.738 |
| SD0687 | 0.722 | 0.644 |
| SD0688 | 0.416 | 0.385 |
| SD0689 | 0.571 | 0.870 |
| SD0690 | 0.697 | 0.946 |
| SD0691 | 0.616 | 0.840 |
| SD0692 | 0.644 | 0.850 |
| SD0693 | 0.781 | 0.733 |
| SD0694 | 1.022 | 0.902 |
| SD0695 | 0.458 | 0.448 |
| SD0696 | 0.500 | 0.455 |
| SD0697 | 0.454 | 0.444 |
| SD0698 | 0.497 | 0.467 |
| SD0699 | 0.369 | 0.416 |
| SD0700 | 0.622 | 0.552 |
| SD0701 | 0.542 | 0.528 |
| SD0702 | 0.301 | 0.423 |
| SD0703 | 0.376 | 0.367 |
| SD0704 | 0.373 | 0.334 |
| SD0705 | 0.315 | 0.347 |
| SD0706 | 0.339 | 0.351 |
| SD0707 | 0.245 | 0.263 |
| SD0708 | 0.572 | 0.703 |
| SD0709 | 0.313 | 0.484 |
| SD0710 | 0.297 | 0.431 |
| SD0711 | 0.284 | 0.397 |
| SD0712 | 0.300 | 0.471 |
| SD0713 | 0.297 | 0.417 |
| SD0714 | 0.300 | 0.438 |
| SD0715 | 0.280 | 0.430 |

Example 5. In Vivo Analysis of RNAi Agent Efficacy in Transiently Transgenic and Transgenic Mice A) Administration and Sample Collection.

In order to evaluate the efficacy of LPA RNAi agents in vivo, transiently transgenic mice were used. At least 30 days prior to cholesterol-conjugated LPA RNAi agent administration, wild-type mice were injected by hydrodynamic tail vein injection with a plasmid containing the SEAP gene under the control of the mouse albumin promoter. LPA gene target sequences were cloned in the 3' UTR of the plasmid. These mice are noted as SEAP-LPA HTV mice. Cholesterol-conjugated LPA RNAi agents were administered to mice using MLP delivery polymer on day 1 (WO 2012/083185, incorporated herein by reference; melittin was synthesized and modified with CDM-NAG to yield MLP delivery polymer as described therein). Each mouse received an intravenous (IV) injection into the tail vein of 200-250 µL solution containing a dose of LPA RNAi agent+MLP delivery polymer (1:1 w/w RNAi agent: MLP delivery polymer in most cases). In some experiments, LPA RNAi agents were directly conjugated to a delivery polymer. Polymer conjugated LPA RNAi agents were similarly injected into tail vein. The indicated LPA RNAi agent (Table 8B) was conjugated to a polyacrylate polymer, ARF1164-106A-5, having 54.4% ethoxy ethyl amino acrylate (EEAA) amine monomers and 45.6% propyl acrylate propyl monomers (MW 41962 g/mol, polymer synthesized as described in WO 2013/158141) and masked with 3×ACit-NAG, 6×ACit-PEG (polymer masked as described in WO 2012/092373 and PCT/US16/34512). Control serum (pre-treatment) samples were taken from the mice pre-injection on days −4, or −1. Post injection serum samples were taken from the mice days 4, 8, 15, 22, 29, 36, and 43. For some mice, samples were collected on day 3 or day 5, instead of day 4.

In additional experiments, LPA RNAi agents were evaluated in vivo using transiently transgenic mice expressing full length LPA. At least 30 days prior to cholesterol-targeted LPA RNAi agent administration, immune compromised (Nod.scid) mice were injected by hydrodynamic tail vein injection with a minicircle containing the LPA cDNA under the control of the mouse albumin promoter. These mice are noted as LPA mc HTV mice. Either cholesterol-targeted or NAG (also termed GalNAc)-conjugated LPA RNAi agents were administered to mice on day 1. For Cholesterol-targeted RNAi agents, each mouse received an intravenous (IV) injection into the tail vein of 200-250 µL solution containing a dose of RNAi agent+MLP delivery polymer (1:1 w/w RNAi agent:MLP delivery polymer). For NAG conjugated LPA RNAi agents, mice received a subcutaneous (SC) injection into the loose skin on the back between the shoulders of 300 µL solution containing a dose of the RNAi agent in buffered saline. For some sample, the LPA RNAi agent was administered either with or without MLP delivery peptide. RNAi agents delivered with MLP delivery peptide were administered by intravenous (IV) injection into the tail vein of 200-250 µL solution containing a dose of RNAi agent+MLP delivery polymer (1:2 w/w RNAi agent: MLP delivery polymer in most cases). Control serum (pre-treatment) samples were taken from the mice pre-injection on days −4, or −1. Post injection serum samples were taken from the mice days 4, 8, 15, 22, 29, 36, and 43. For some mice, samples were collected on day 3 or day 5, instead of day 4.

In further experiments, LPA RNAi agents were administered to apo(a) and Lp(a) transgenic mice (Frazer K A et al 1995, Nature Genetics 9:424-431). This mouse expresses human apo(a) from a YAC containing the full LPA gene (encoding apo(a) protein) with additional sequences both 5' and 3'. Lp(a) mice were bred by crossing apo(a) YAC-containing mice to human apoB-100 expressing mice (Callow M J et al 1994, PNAS 91:2130-2134). Cholesterol-targeted RNAi agents and NAG conjugated RNAi agents were administered as described above. Control serum (pre-treatment) samples were taken from the mice pre-injection on day −1. Post injection serum samples were taken from the mice days 4, 8, 15, 22, 29, 36, 43, 50, 57 and 64.

B) LPA Expression Knockdown Analyses.

For SEAP-LPA HTV mice, SEAP protein levels in serum were monitored by assaying serum from the mice using Phospha-Light™, a chemiluminescent reporter gene assay system (Life Technologies). For normalization, SEAP level for each animal at a given time point was divided by the pre-treatment level of expression in that animal to determine the ratio of expression "normalized to pre-treatment". Expression at a specific time point was then averaged amongst individuals within the group.

For LPA mc HTV mice and transgenic mice, human apo(a) protein levels in serum were monitored by assaying serum from mice using an ELISA for apo(a) (Abcam). For normalization, apo(a) level for each animal at a time point was divided by the pre-treatment level of expression in that animal (in this case at day 1) to determine the ratio of expression "normalized to day 1". Expression at a specific time point was then normalized to the saline control group by dividing the "normalized to day 1" ratio for an individual animal by the mean "normalized to day 1" ratio of all mice in the saline control group. This resulted in expression for each time point normalized to that in the control group.

Lp(a) levels were determined on a Cobas Integra 400 (Roche Diagnostics) according to the manufacturer's recommendations. For normalization, apo(a) level for each animal at a time point was divided by the pre-treatment level of expression in that animal (in this case at day 1) to determine the ratio of expression "normalized to day 1". Expression at a specific time point was then normalized to the saline control group by dividing the "normalized to day 1" ratio for an individual animal by the mean "normalized to day 1" ratio of all mice in the saline control group. This resulted in expression for each time point normalized to that in the control group.

TABLE 8A

Relative LPA levels in mouse following intravenous administration of cholesterol-conjugated LPA RNAi agents + MLP delivery polymer.

| Duplex ID | LPA RNAi agent (mg/kg) | MLP (mg/kg) | Relative LPA |
|---|---|---|---|
| AD01184 | 2 | 2 | 0.20 |
| AD01187 | 2 | 2 | 0.18 |
| AD01190 | 2 | 2 | 0.17 |
| AD01193 | 2 | 2 | 0.22 |
| AD01196 | 2 | 2 | 0.02 |
| AD01197 | 2 | 2 | 0.065 |
| AD01198 | 2 | 2 | 0.051 |
| AD01199 | 2 | 2 | 0.070 |
| AD01200 | 2 | 2 | 0.094 |
| AD01201 | 2 | 2 | 0.029 |
| AD01202 | 8 | 8 | 0.14 |
| AD01205 | 2 | 2 | 0.21 |
| AD01206 | 2 | 2 | 0.37 |
| AD01207 | 2 | 2 | 0.19 |
| AD01208 | 2 | 2 | 0.35 |
| AD01209 | 2 | 2 | 0.16 |
| AD01210 | 2 | 2 | 0.18 |
| AD01211 | 2 | 2 | 0.38 |
| AD01212 | 2 | 2 | 0.26 |
| AD01213 | 2 | 2 | 0.30 |
| AD02662 | 2 | 2 | 0.0010 |
| AD02663 | 2 | 2 | 0.010 |
| AD02664 | 2 | 2 | 0.0010 |

TABLE 8B

Relative LPA levels in mouse following intravenous administration of delivery polymer-conjugated LPA RNAi agents.

| Duplex ID | LPA RNAi agent (mg/kg) | Relative LPA |
|---|---|---|
| AD01462 | 0.5 | 0.38 |
| AD01463 | 0.5 | 0.41 |
| AD01466 | 0.5 | 0.33 |
| AD01467 | 0.5 | 0.46 |

TABLE 8C

Relative LPA levels in mouse following subcutaneous administration of NAG-conjugated LPA RNAi agents.

| Duplex ID | LPA RNAi agent (mg/kg) | Relative LPA |
|---|---|---|
| AD01529 | 10 | 0.068 |
| AD01530 | 10 | 0.43 |
| AD01531 | 10 | 0.62 |
| AD01532 | 10 | 0.18 |
| AD01533 | 10 | 0.30 |
| AD01534 | 10 | 0.44 |
| AD01765 | 10 | 0.14 |
| AD01766 | 10 | 0.52 |
| AD01767 | 10 | 0.51 |
| AD01768 | 10 | 0.15 |
| AD01769 | 10 | 0.56 |
| AD01770 | 10 | 0.29 |
| AD01772 | 10 | 0.25 |
| AD01773 | 10 | 0.28 |
| AD01774 | 10 | 0.24 |
| AD01780 | 10 | 0.34 |
| AD01804 | 10 | 0.68 |
| AD01976 | 10 | 0.27 |
| AD01977 | 10 | 0.27 |
| AD01978 | 10 | 0.53 |
| AD01979 | 10 | 0.044 |
| AD01980 | 10 | 0.087 |
| AD01981 | 10 | 0.074 |
| AD01982 | 10 | 0.066 |
| AD01983 | 10 | 0.078 |
| AD01984 | 10 | 0.036 |
| AD01985 | 10 | 0.0070 |
| AD01986 | 10 | 0.019 |
| AD01987 | 10 | 0.019 |
| AD01988 | 10 | 0.042 |
| AD01989 | 10 | 0.053 |
| AD01990 | 10 | 0.017 |
| AD02001 | 10 | 0.021 |
| AD02003 | 10 | 0.050 |
| AD02004 | 10 | 0.050 |
| AD02005 | 10 | 0.040 |
| AD02006 | 10 | 0.11 |
| AD02007 | 10 | 0.21 |
| AD02008 | 10 | 0.080 |
| AD02009 | 10 | 0.090 |
| AD02010 | 10 | 0.16 |
| AD02011 | 10 | 0.070 |
| AD02435 | 10 | 0.038 |
| AD02436 | 10 | 0.027 |
| AD02437 | 10 | 0.052 |
| AD02438 | 10 | 0.063 |
| AD02439 | 10 | 0.073 |
| AD02440 | 10 | 0.13 |
| AD02545 | 10 | 0.079 |
| AD02546 | 10 | 0.045 |
| AD02547 | 10 | 0.055 |
| AD02548 | 10 | 0.13 |
| AD02549 | 10 | 0.071 |
| AD02550 | 10 | 0.039 |
| AD02551 | 10 | 0.057 |
| AD02552 | 10 | 0.033 |
| AD02553 | 10 | 0.14 |
| AD02554 | 10 | 0.14 |
| AD02555 | 10 | 0.18 |
| AD02556 | 10 | 0.10 |
| AD02557 | 10 | 0.10 |
| AD02558 | 10 | 0.071 |
| AD02559 | 10 | 0.039 |
| AD02560 | 10 | 0.058 |
| AD02561 | 10 | 0.12 |
| AD02609 | 3 | 0.59 |
| AD02610 | 3 | 0.36 |
| AD02611 | 3 | 0.35 |
| AD02612 | 3 | 0.37 |
| AD02613 | 3 | 0.24 |
| AD02614 | 3 | 0.24 |
| AD02615 | 3 | 0.14 |
| AD02616 | 3 | 0.25 |
| AD02617 | 3 | 0.090 |
| AD02618 | 3 | 0.11 |
| AD02619 | 3 | 0.020 |
| AD02620 | 3 | 0.11 |
| AD02682 | 10 | 0.11 |
| AD02683 | 10 | 0.14 |
| AD02684 | 10 | 0.79 |
| AD02685 | 10 | 0.78 |
| AD02686 | 10 | 0.19 |
| AD02687 | 10 | 0.27 |
| AD02696 | 3 | 0.050 |
| AD02710 | 3 | 0.040 |
| AD02711 | 3 | 0.040 |
| AD02712 | 3 | 0.49 |
| AD02713 | 3 | 0.040 |
| AD02714 | 3 | 0.040 |
| AD02715 | 3 | 0.070 |
| AD02716 | 3 | 0.080 |
| AD02717 | 3 | 0.12 |
| AD02745 | 3 | 0.25 |
| AD02746 | 3 | 0.22 |
| AD02747 | 3 | 0.081 |
| AD02748 | 3 | 0.17 |
| AD02749 | 3 | 0.17 |
| AD02750 | 3 | 0.066 |
| AD02751 | 3 | 0.070 |
| AD02752 | 3 | 0.044 |
| AD02753 | 3 | 0.071 |
| AD02819 | 1 | 0.022 |
| AD02820 | 1 | 0.042 |
| AD02821 | 1 | 0.038 |
| AD02825 | 3 | 0.050 |
| AD02826 | 3 | 0.050 |
| AD02827 | 3 | 0.050 |
| AD02828 | 3 | 0.050 |
| AD02829 | 3 | 0.040 |
| AD02830 | 3 | 0.040 |
| AD02831 | 3 | 0.030 |
| AD02832 | 3 | 0.030 |
| AD02841 | 3 | 0.061 |
| AD02842 | 3 | 0.16 |
| AD02843 | 3 | 0.10 |
| AD02844 | 3 | 0.11 |
| AD02845 | 3 | 0.22 |
| AD02846 | 3 | 0.16 |
| AD02847 | 3 | 0.066 |
| AD02848 | 3 | 0.055 |
| AD02849 | 3 | 0.083 |
| AD02850 | 3 | 0.042 |
| AD02851 | 3 | 0.063 |
| AD02852 | 3 | 0.11 |
| AD02907 | 10 | 0.10 |
| AD02908 | 10 | 0.11 |
| AD02909 | 10 | 0.049 |
| AD02910 | 10 | 0.23 |
| AD02911 | 10 | 0.20 |
| AD02912 | 10 | 0.10 |
| AD02913 | 10 | 0.070 |

TABLE 8C-continued

Relative LPA levels in mouse following subcutaneous administration of NAG-conjugated LPA RNAi agents.

| Duplex ID | LPA RNAi agent (mg/kg) | Relative LPA |
|---|---|---|
| AD02914 | 10 | 0.050 |
| AD02915 | 10 | 0.10 |
| AD02916 | 10 | 0.090 |
| AD02917 | 10 | 0.060 |
| AD02918 | 10 | 0.020 |
| AD02919 | 10 | 0.030 |
| AD02920 | 10 | 0.050 |
| AD02921 | 10 | 0.040 |
| AD02922 | 10 | 0.080 |
| AD02923 | 10 | 0.040 |
| AD02924 | 10 | 0.050 |
| AD02925 | 10 | 0.030 |
| AD02926 | 10 | 0.17 |
| AD02927 | 10 | 0.31 |
| AD02928 | 10 | 0.081 |
| AD02929 | 10 | 0.065 |
| AD02930 | 10 | 0.15 |
| AD02931 | 10 | 0.13 |
| AD02932 | 10 | 0.11 |
| AD03049 | 3 | 0.20 |
| AD03050 | 3 | 0.087 |
| AD03051 | 3 | 0.070 |
| AD03052 | 3 | 0.080 |
| AD03053 | 3 | 0.23 |
| AD03054 | 3 | 0.050 |
| AD03058 | 3 | 0.27 |
| AD03059 | 3 | 0.22 |
| AD03060 | 3 | 0.31 |
| AD03061 | 3 | 0.16 |
| AD03062 | 3 | 0.20 |
| AD03063 | 3 | 0.13 |
| AD03064 | 3 | 0.21 |
| AD03065 | 3 | 0.085 |
| AD03066 | 3 | 0.10 |
| AD03067 | 3 | 0.094 |
| AD03068 | 3 | 0.17 |
| AD03069 | 3 | 0.077 |
| AD03070 | 3 | 0.36 |
| AD03071 | 3 | 0.043 |
| AD03072 | 3 | 0.031 |
| AD03073 | 3 | 0.019 |
| AD03074 | 3 | 0.016 |
| AD03075 | 3 | 0.062 |
| AD03114 | 1 | 0.33 |
| AD03115 | 1 | 0.30 |
| AD03116 | 1 | 0.21 |
| AD03117 | 1 | 0.14 |
| AD03118 | 1 | 0.30 |
| AD03119 | 1 | 0.10 |
| AD03120 | 1 | 0.080 |
| AD03121 | 1 | 0.14 |
| AD03122 | 1 | 0.14 |
| AD03123 | 1 | 0.34 |
| AD03156 | 1 | 0.084 |
| AD03157 | 1 | 0.016 |
| AD03158 | 1 | 0.037 |
| AD03159 | 1 | 0.63 |
| AD03272 | 1 | 0.13 |
| AD03273 | 1 | 0.20 |
| AD03274 | 1 | 0.21 |
| AD03275 | 1 | 0.15 |
| AD03276 | 1 | 0.11 |
| AD03277 | 1 | 0.13 |
| AD03278 | 1 | 0.13 |
| AD03279 | 1 | 0.21 |
| AD03341 | 1 | 0.13 |
| AD03421 | 1 | 0.29 |
| AD03430 | 1 | 0.12 |
| AD03432 | 1 | 0.16 |
| AD03434 | 1 | 0.11 |
| AD03436 | 1 | 0.21 |
| AD03438 | 1 | 0.25 |
| AD03440 | 1 | 0.21 |
| AD03460 | 1 | 0.090 |
| AD03462 | 1 | 0.40 |
| AD03495 | 1 | 0.28 |
| AD03536 | 1 | 0.14 |
| AD03538 | 0.5 | 0.26 |
| AD03539 | 0.5 | 0.21 |
| AD03540 | 1 | 0.15 |
| AD03541 | 0.5 | 0.10 |
| AD03542 | 1 | 0.94 |
| AD03547 | 1 | 0.19 |
| AD03548 | 1 | 0.73 |
| AD03549 | 1 | 0.29 |
| AD03573 | 1 | 0.15 |
| AD03574 | 1 | 0.15 |
| AD03575 | 1 | 0.13 |
| AD03576 | 1 | 0.18 |
| AD03577 | 0.5 | 0.18 |
| AD03578 | 0.5 | 0.38 |
| AD03579 | 0.5 | 0.53 |
| AD03603 | 1 | 0.083 |
| AD03604 | 1 | 0.091 |
| AD03605 | 1 | 0.19 |
| AD03608 | 1 | 0.18 |
| AD03609 | 1 | 0.16 |
| AD03610 | 1 | 0.23 |
| AD03611 | 1 | 0.40 |
| AD03612 | 1 | 0.21 |
| AD03629 | 1 | 0.11 |
| AD03668 | 1 | 0.070 |
| AD03705 | 0.5 | 0.11 |
| AD03707 | 0.5 | 0.11 |
| AD03720 | 0.5 | 0.14 |
| AD03721 | 0.5 | 0.094 |
| AD03722 | 0.5 | 0.19 |
| AD03723 | 0.5 | 0.10 |
| AD03765 | 1 | 0.080 |
| AD03771 | 1 | 0.10 |
| AD03801 | 1 | 0.15 |
| AD03802 | 1 | 0.18 |
| AD03844 | 1 | 0.17 |
| AD03845 | 1 | 0.25 |
| AD03848 | 1 | 0.10 |
| AD03850 | 1 | 0.052 |
| AD03851 | 1 | 0.076 |
| AD03852 | 1 | 0.13 |
| AD03853 | 1 | 0.081 |
| AD03854 | 1 | 0.21 |
| AD03856 | 1 | 0.32 |
| AD03859 | 1 | 0.15 |
| AD03862 | 1 | 0.12 |
| AD03863 | 1 | 0.12 |
| AD03921 | 1 | 0.17 |
| AD03922 | 1 | 0.057 |
| AD03923 | 1 | 0.066 |
| AD03924 | 1 | 0.14 |
| AD03931 | 1 | 0.34 |
| AD03932 | 1 | 0.15 |
| AD03933 | 1 | 0.34 |
| AD03424 | 1 | 0.15 |
| AD03425 | 1 | 0.21 |
| AD03426 | 1 | 0.21 |
| AD03427 | 1 | 0.19 |
| AD03428 | 1 | 0.18 |
| AD03760 | 0.5 | 0.21 |
| AD03762 | 0.5 | 0.17 |
| AD03763 | 0.5 | 0.21 |
| AD03764 | 0.5 | 0.28 |
| AD03766 | 0.5 | 0.065 |
| AD03847 | 1 | 0.15 |
| AD04110 | 1 | 0.070 |

Example 6. In Vivo Screening of LPA RNAi Agents and Time Course of SEAP Knockdown Cholesterol-conjugated LPA RNAi agents were administered to transiently transgenic mice as described above. Each mouse received a single intravenous (IV) dose of 8 mg/kg of LPA RNAi agent with 8 mg/kg of MLP delivery polymer. SEAP protein levels in serum were monitored for up to 36 days. Knockdown levels and duration of response are shown in Table 9. A decrease in SEAP serum protein level of greater than 85% was obtained following administration of all LPA RNAi agents tested; with all but two LPA RNAi agents tested showing greater than 99.4% knockdown. AD01196 and AD01199 showed >95% knockdown at day 36.

Example 7. In Vivo Screening LPA RNAi Agents and Time Course of LPA Knockdown at Lower LPA RNAi Agent Doses Cholesterol-conjugated LPA RNAi agents were administered to transiently transgenic mice as described above. Each mouse received a single intravenous (IV) dose of 2 mg/kg of LPA RNAi agent with 2 mg/kg of MLP delivery polymer. SEAP protein levels in serum were monitored for up to 43 days (Table 10).

Example 8. In Vivo Testing of LPA RNAi Agents in Apo(a) Transgenic (Tg) Mice AD01196 was administered to mice as described above. Each mouse received a single intravenous (IV) dose of either 2 mg/kg of LPA RNAi agent with 2 mg/kg of MLP delivery polymer or saline. Human apo(a) (apo(a)) levels in serum were monitored for up to 64 days (Table 11). At day 15, animals in the saline group received a single IV dose of 2 mg/kg of a control mouse Factor VII (F7) RNAi agent with 2 mg/kg of MLP delivery polymer. At day 22, F7 levels were measured in all animals. F7 activity was knocked down by 99% 7 days post dosing, with no effect on serum apo(a) levels. AD01196 showed >3 log 10 knockdown of apo(a) levels at nadir, with >80% knockdown observed after 3 weeks (Table 11).

TABLE 9

Serum SEAP protein levels in SEAP-LPA HTV mice following administration of 8 mg/kg chol-RNAi agents with 8 mg/kg MLP delivery peptide. SEAP levels were normalized to day −1 and saline control.

| Treatment | Day −1 Ave | SD | Day 4 Ave | SD | Day 8 Ave | SD | Day 15 Ave | SD | Day 22 Ave | SD | Day 29 Ave | SD | Day 36 Ave | SD |
|---|---|---|---|---|---|---|---|---|---|---|---|---|---|---|
| Saline | 1.00 | 0.24 | 1.00 | 0.34 | 1.00 | 0.13 | 1.00 | 0.33 | 1.00 | 0.09 | 1.00 | 0.18 | 1.00 | 0.44 |
| AD01184 | 1.00 | 0.39 | 0.27 | 0.10 | 0.15 | 0.06 | 0.01 | 0.00 | 0.07 | 0.04 | 0.43 | 0.39 | 0.98 | 0.73 |
| AD01187 | 1.00 | 0.53 | 0.24 | 0.15 | 0.13 | 0.10 | 0.00 | 0.00 | 0.01 | 0.01 | 0.08 | 0.06 | 0.56 | 0.47 |
| AD01190 | 1.00 | 0.77 | 0.26 | 0.20 | 0.14 | 0.11 | 0.00 | 0.00 | 0.00 | 0.00 | 0.00 | 0.00 | 0.02 | 0.01 |
| AD01193 | 1.00 | 0.99 | 0.25 | 0.26 | 0.15 | 0.17 | 0.01 | 0.01 | 0.00 | 0.00 | 0.01 | 0.01 | 0.02 | 0.01 |
| AD01196 | 1.00 | 0.59 | 0.24 | 0.13 | 0.14 | 0.08 | 0.00 | 0.00 | 0.00 | 0.00 | 0.01 | 0.01 | 0.04 | 0.03 |
| AD01199 | 1.00 | 0.52 | 0.23 | 0.15 | 0.13 | 0.10 | 0.00 | 0.00 | 0.00 | 0.00 | 0.01 | 0.00 | 0.04 | 0.02 |
| AD01202 | 1.00 | 0.93 | 0.25 | 0.24 | 0.17 | 0.16 | 0.14 | 0.12 | 0.56 | 0.55 | 0.78 | 0.66 | 2.09 | 2.00 |

TABLE 10

Serum SEAP protein levels in SEAP-LPA HTV mice following administration of 2 mg/kg chol-RNAi agents with 2 mg/kg MLP delivery peptide. SEAP levels were normalized to day −1 and saline control.

| Treatment | Day −4 Ave. | SD | Day 4 Ave. | SD | Day 9 Ave. | SD | Day 15 Ave. | SD | Day 22 Ave. | SD | Day 29 Ave. | SD | Day 36 Ave. | SD | Day 43 Ave. | SD |
|---|---|---|---|---|---|---|---|---|---|---|---|---|---|---|---|---|
| Saline | 1.00 | 0.00 | 1.00 | 0.72 | 1.00 | 0.72 | 1.00 | 0.71 | 1.00 | 0.43 | 1.00 | 0.79 | 1.00 | 0.48 | 1.00 | 0.54 |
| AD01196 | 1.00 | 0.00 | 0.22 | 0.08 | 0.05 | 0.05 | 0.02 | 0.01 | 0.13 | 0.04 | 0.36 | 0.12 | 0.69 | 0.08 | 1.39 | 0.91 |
| AD01199 | 1.00 | 0.00 | 0.27 | 0.28 | 0.07 | 0.06 | 0.17 | 0.17 | 0.59 | 0.51 | 0.74 | 0.74 | 0.83 | 0.82 | 1.01 | 0.58 |
| AD01205 | 1.00 | 0.00 | 0.21 | 0.13 | 0.31 | 0.23 | 0.45 | 0.21 | 1.33 | 0.68 | 1.11 | 0.82 | 1.55 | 1.30 | 1.79 | 1.09 |
| AD01208 | 1.00 | 0.00 | 0.43 | 0.20 | 0.35 | 0.15 | 0.68 | 0.19 | 1.45 | 0.44 | 1.32 | 0.26 | 1.39 | 0.52 | 0.99 | 0.12 |
| AD01211 | 1.00 | 0.00 | 0.38 | 0.14 | 0.53 | 0.20 | 0.94 | 0.38 | 1.96 | 0.93 | 1.05 | 0.27 | 1.44 | 0.38 | 0.93 | 0.28 |
| AD01184 | 1.00 | 0.00 | 0.26 | 0.07 | 0.20 | 0.05 | 0.61 | 0.17 | 1.28 | 0.14 | 1.21 | 0.51 | 1.39 | 0.80 | ND | ND |
| AD01187 | 1.00 | 0.00 | 0.37 | 0.18 | 0.09 | 0.07 | 0.18 | 0.17 | 0.86 | 0.84 | 0.77 | 0.33 | 1.80 | 0.36 | ND | ND |
| AD01190 | 1.00 | 0.00 | 0.26 | 0.08 | 0.17 | 0.07 | 0.36 | 0.13 | 1.16 | 0.37 | 1.39 | 0.69 | 1.96 | 1.64 | ND | ND |
| AD01193 | 1.00 | 0.00 | 0.39 | 0.27 | 0.22 | 0.33 | 0.32 | 0.37 | 0.67 | 0.58 | 0.84 | 0.46 | 1.27 | 0.23 | ND | ND |

TABLE 11

Serum apo(a) protein levels in apo(a) Tg mice following administration of 2 mg/kg cholesterol-conjugated LPA RNAi agent with 2 mg/kg MLP delivery polymer. Apo(a) levels were normalized to day −1 and saline control.

| Treatment | Day −1 Ave | SD | Day 4 Ave | SD | Day 8 Ave | SD | Day 15 Ave | SD | Day 22 Ave | SD |
|---|---|---|---|---|---|---|---|---|---|---|
| Saline | 1.00 | 0.00 | 1.00 | 0.06 | 1.00 | 0.27 | 1.00 | 0.06 | 1.00 | 0.17 |
| AD01196 | 1.00 | 0.00 | 0.00 | 0.00 | 0.00 | 0.00 | 0.01 | 0.00 | 0.15 | 0.08 |

| Treatment | Day 29 Ave | SD | Day 36 Ave | SD | Day 43 Ave | SD | Day 50 Ave | SD |
|---|---|---|---|---|---|---|---|---|
| Saline | 1.00 | 0.12 | 1.00 | 0.04 | 1.00 | 0.26 | 1.00 | 0.24 |
| AD01196 | 0.40 | 0.23 | 0.74 | 0.61 | 0.75 | 0.67 | 0.77 | 0.52 |

Figure 3:
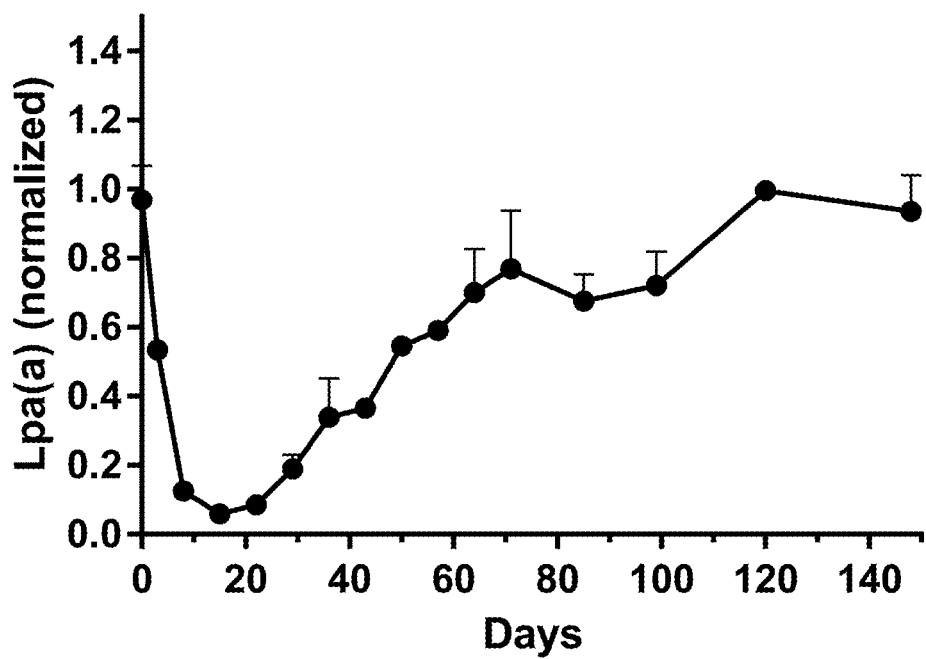
FIG. 3. Graph illustrating Lp(a) particle levels in Cynomolgus monkey serum following administration of a single 2 mg/kg AD01196 LPA RNAi agent dosed 1:1 (wt/wt) with delivery polymer on day 1. Lp(a) levels were normalized to two pre-dose values (shown as day 0).

Example 9. Apolipoprotein (a) (Apo(a)) Knockdown in Non-Human Primates Following LPA RNAi Agent Delivery by MLP Delivery Polymer MLP delivery polymer and LPA RNAi agent were made and combined in a pharmaceutically acceptable buffer as described above. On day 1, two cynomolgus macaque (*Macaca fascicularis*) primates (both male, 5.0 kg and 8.15 kg, respectively) were injected with 2 mg/kg AD01196+2 mg/kg MLP delivery polymer. For each injection, the LPA RNAi agent+MLP delivery polymer (2 ml/kg) was injected into the saphenous vein using a 22 to 25 gauge intravenous catheter. At the indicated time points (indicated in Table 12), blood samples were drawn and analyzed for apo(a) levels, lipid levels and toxicity markers. Blood was collected from the femoral vein and primates were fasted overnight before all blood collections. Blood tests for blood urea nitrogen (BUN), alanine transaminase (ALT), aspartate aminotransferase (AST), creatinine, total cholesterol (TC) and triglycerides (TG) were performed on an automated chemistry analyzer at Meriter laboratories. Blood tests for Lipoprotein (a) (Lp(a)) and Low density lipoprotein (LDL) were measured on an automated chemistry analyzer. Serum apo(a) levels were measured by ELISA. Significant knockdown of apo(a) was observed with an average maximum knockdown of 94.5% observed at day 22. Average maximum knockdown of Lp(a) was 91.5% observed at day 15 (FIG. 3). No dose-related toxicity was observed in treated animals.

TABLE 12

Serum apo(a) protein, Lipoprotein(a) (mg/dL), Low density Lipoprotein (LDL), Total cholesterol, and triglyceride levels in cynomolgus macaque (*Macaca fascicularis*) primates following administration of 2 mg/kg AD01196 with 2 mg/kg MLP delivery polymer. Apo(a) levels were normalized to predose.

| | Serum apo(a) protein levels | | Lipoprotein(a) levels (mg/dL) | | Low Density Lipoprotein calculated (mg/dL) | | Total Cholesterol (mg/dL) | | Triglycerides (mg/dL) | |
|---|---|---|---|---|---|---|---|---|---|---|
| day | animal 1 | animal 2 | animal 1 | animal 2 | animal 1 | animal 2 | animal 1 | animal 2 | animal 1 | animal 2 |
| pre | 1.00 | 1.00 | 77.1 | 126.7 | 48.4 | 84.7 | 95 | 149 | 41 | 36 |
| 3 | 0.47 | 0.55 | 46.0 | 65.0 | 53.6 | 83.5 | 93 | 143 | 33 | 28 |
| 8 | 0.12 | 0.15 | 9.3 | 16.5 | 53.4 | 75.9 | 101 | 147 | 36 | 30 |
| 15 | 0.10 | 0.10 | 5.0 | 7.3 | 49.8 | 60.9 | 106 | 136 | 79 | 34 |
| 22 | 0.05 | 0.06 | 7.9 | 10.3 | 47.5 | 63.9 | 97 | 136 | 34 | 36 |
| 29 | 0.08 | 0.11 | 13.4 | 27.0 | 55.7 | 47.5 | 101 | 116 | 20 | 36 |
| 36 | 0.15 | 0.25 | 22.2 | 50.6 | 56.8 | 73.1 | — | — | — | — |
| 43 | 0.19 | 0.23 | 31.4 | 45.5 | 53.8 | 55.7 | 103 | 138 | 29 | 39 |
| 50 | 0.27 | 0.29 | 46.1 | 67.3 | 52.3 | 70.9 | — | — | — | — |
| 57 | 0.27 | 0.3 | 52.7 | 69.7 | 52.1 | 78.6 | 104 | 157 | 34 | 39 |
| 64 | 0.33 | 0.31 | 68.4 | 73.7 | 52.4 | 75.8 | — | — | — | — |
| 71 | 0.50 | 0.4 | 76.8 | 78.6 | 62.4 | 75.0 | 104 | 149 | 43 | 47 |
| 85 | 0.31 | 0.34 | 63.1 | 75.4 | 50.3 | 68.8 | 102 | 145 | 41 | 49 |
| 99 | 0.27 | 0.29 | 67.9 | 78.8 | 58.7 | 72.5 | 102 | 150 | 42 | 52 |
| 120 | 0.36 | 0.37 | 91.7 | 119.4 | 53.4 | 79.8 | 100 | 154 | 43 | 51 |

TABLE 13

Urea Nitrogen, Creatinine, Alanine transaminase, and Aspartate aminotransferase levels in cynomolgus macaque (*Macaca fascicularis*) primates following administration of 2 mg/kg AD01196 with 2 mg/kg MLP delivery polymer.

| day | Blood Urea Nitrogen (mg/dL) | | Creatinine (mg/dL) | | Alanine transaminase (U/L) | | Aspartate aminotransferase (U/L) | |
|---|---|---|---|---|---|---|---|---|
| | animal 1 | animal 2 | animal 1 | animal 2 | animal 1 | animal 2 | animal 1 | animal 2 |
| predose | 16 | 16 | 0.79 | 0.70 | 37 | 32 | 32 | 33 |
| 3 | 11 | 14 | 0.70 | 0.61 | 40 | 42 | 33 | 35 |
| 8 | 14 | 13 | 0.78 | 0.58 | 33 | 38 | 25 | 31 |
| 15 | 15 | 15 | 0.67 | 0.59 | 51 | 35 | 47 | 32 |
| 22 | 15 | 15 | 0.8 | 0.55 | 47 | 35 | 29 | 30 |
| 29 | 12 | 12 | 0.61 | 0.59 | 30 | 31 | 23 | 36 |
| 36 | — | — | — | — | — | — | — | — |
| 43 | 12 | 15 | 0.64 | 0.58 | 29 | 29 | 25 | 30 |
| 50 | — | — | — | — | — | — | — | — |
| 57 | 14 | 15 | 0.72 | 0.64 | 32 | 35 | 28 | 31 |
| 64 | — | — | — | — | — | — | — | — |
| 71 | 14 | 15 | 0.73 | 0.69 | 36 | 35 | 29 | 33 |
| 85 | 14 | 15 | 0.60 | 0.70 | 126 | 41 | 51 | 40 |
| 99 | 15 | 18 | 0.66 | 0.68 | 151 | 40 | 44 | 37 |
| 120 | 14 | 19 | 0.72 | 0.60 | 37 | 51 | 28 | 47 |

Example 10. In Vivo Screening of NAG-Conjugated LPA RNAi Agents and Time Course of Knockdown NAG-conjugated LPA RNAi agents were administered to transiently transgenic mice as described above. Each mouse received either single intravenous (IV) dose of 2 mg/kg of LPA RNAi agent with 1 mg/kg of MLP delivery polymer, or a single subcutaneous (SC) dose of 10 mg/kg of the NAG-conjugated LPA RNAi agent. SEAP protein levels in serum were monitored for up to 22 days. Knockdown levels and duration of response are shown in Tables 14-15. AD01529, AD01532 and AD01533 showed ≥85% knockdown of SEAP levels following IV administration with MLP deliver polymer, and ≥60% maximum knockdown of SEAP levels following SC administration of the NAG-conjugated LPA RNAi agent alone.

TABLE 14

Serum SEAP protein levels in SEAP-LPA HTV mice following SC administration of 10 mg/kg NAG-conjugated LPA RNAi agents. SEAP levels were normalized to day −1 and saline control.

| Treatment | Day −1 | | Day 4 | | Day 8 | | Day 15 | | Day 22 | |
|---|---|---|---|---|---|---|---|---|---|---|
| | Ave | SD | Ave | SD | Ave | SD | Ave | SD | Ave | SD |
| Saline | 1.00 | 0.00 | 1.00 | 0.14 | 1.00 | 0.14 | 1.00 | 0.66 | 1.00 | 0.27 |
| AD01529 | 1.00 | 0.00 | 0.45 | 0.07 | 0.36 | 0.03 | 0.60 | 0.08 | 0.90 | 0.37 |
| AD01530 | 1.00 | 0.00 | 0.46 | 0.15 | 0.43 | 0.10 | 0.79 | 0.26 | 0.79 | 0.32 |
| AD01531 | 1.00 | 0.00 | 0.64 | 0.13 | 0.62 | 0.06 | 0.99 | 0.28 | 1.17 | 0.29 |
| AD01532 | 1.00 | 0.00 | 0.41 | 0.12 | 0.37 | 0.11 | 0.99 | 0.34 | 1.33 | 0.11 |
| AD01533 | 1.00 | 0.00 | 0.40 | 0.03 | 0.22 | 0.08 | 0.37 | 0.15 | 0.63 | 0.13 |
| AD01534 | 1.00 | 0.00 | 0.65 | 0.19 | 0.44 | 0.19 | 0.74 | 0.30 | 1.17 | 0.55 |

TABLE 15

Serum SEAP protein levels in SEAP-LPA HTV mice following IV administration of 1 mg/kg NAG-conjugated LPA RNAi agents + 2 mg/kg MLP delivery polymer. SEAP levels were normalized to day −1 and saline control.

| Treatment | Day −1 | | Day 4 | | Day 8 | | Day 15 | | Day 22 | |
|---|---|---|---|---|---|---|---|---|---|---|
| | Ave | SD | Ave | SD | Ave | SD | Ave | SD | Ave | SD |
| Saline | 1.00 | 0.00 | 1.00 | 0.33 | 1.00 | 0.46 | 1.00 | 0.21 | 1.00 | 0.39 |
| F7 Control | 1.00 | 0.00 | 0.61 | 0.05 | 0.71 | 0.45 | 1.25 | 0.44 | 1.05 | 0.49 |
| AD01529 | 1.00 | 0.00 | 0.25 | 0.04 | 0.15 | 0.08 | 0.47 | 0.24 | 0.81 | 0.40 |
| AD01530 | 1.00 | 0.00 | 0.26 | 0.06 | 0.28 | 0.19 | 0.78 | 0.60 | 1.06 | 0.63 |
| AD01531 | 1.00 | 0.00 | 0.22 | 0.07 | 0.26 | 0.06 | 0.72 | 0.21 | 1.04 | 0.12 |
| AD01532 | 1.00 | 0.00 | 0.18 | 0.05 | 0.06 | 0.03 | 0.13 | 0.08 | 0.29 | 0.18 |
| AD01533 | 1.00 | 0.00 | 0.21 | 0.04 | 0.13 | 0.06 | 0.32 | 0.15 | 0.67 | 0.28 |
| AD01534 | 1.00 | 0.00 | 0.17 | 0.04 | 0.22 | 0.06 | 0.66 | 0.24 | 0.94 | 0.24 |

Example 11. In Vivo Screening of Modified NAG-Conjugated LPA RNAi Agents and Time Course of Knockdown The indicated NAG-conjugated LPA RNAi agents were administered to SEAP-LPA HTV mice as described above. Each mouse received a single subcutaneous (SC) dose of 10 mg/kg of the NAG-conjugated LPA RNAi agent. SEAP protein levels in serum were monitored for up to 22 days. Knockdown levels and duration of response are shown in Tables 16-17. AD01765 and AD01768 showed 89% knockdown activity.

TABLE 16

Serum SEAP protein levels in SEAP-LPA HTV mice following SC administration of 10 mg/kg NAG-conjugated LPA RNAi agent. SEAP levels were normalized to day −1 and saline control.

| Treatment | Day −1 Ave | SD | Day 3 Ave | SD | Day 8 Ave | SD | Day 15 Ave | SD | Day 22 Ave | SD |
|---|---|---|---|---|---|---|---|---|---|---|
| Saline | 1.00 | 0.00 | 1.00 | 0.16 | 1.00 | 0.16 | 1.00 | 0.28 | 1.00 | 0.24 |
| AD01533 | 1.00 | 0.00 | 0.41 | 0.08 | 0.22 | 0.02 | 0.47 | 0.20 | 0.66 | 0.29 |
| AD01772 | 1.00 | 0.00 | 0.46 | 0.13 | 0.18 | 0.00 | 0.34 | 0.09 | 0.61 | 0.14 |
| AD01773 | 1.00 | 0.00 | 0.47 | 0.08 | 0.20 | 0.08 | 0.45 | 0.15 | 0.83 | 0.12 |
| AD01774 | 1.00 | 0.00 | 0.49 | 0.09 | 0.18 | 0.03 | 0.44 | 0.13 | 0.68 | 0.08 |
| AD01780 | 1.00 | 0.00 | 0.52 | 0.13 | 0.25 | 0.09 | 0.44 | 0.26 | 0.65 | 0.37 |

TABLE 17

Serum SEAP protein levels in SEAP-LPA HTV mice following SC administration of 10 mg/kg NAG-conjugated LPA RNAi agent. SEAP levels were normalized to day −1 and saline control.

| Treatment | Day −1 Ave | SD | Day 3 Ave | SD | Day 8 Ave | SD | Day 15 Ave | SD | Day 22 Ave | SD |
|---|---|---|---|---|---|---|---|---|---|---|
| Saline | 1.00 | 0.00 | 1.00 | 0.27 | 1.00 | 0.73 | 1.00 | 0.87 | 1.00 | 0.80 |
| AD01532 | 1.00 | 0.00 | 0.42 | 0.19 | 0.35 | 0.21 | 0.85 | 0.25 | 1.27 | 0.57 |
| AD01765 | 1.00 | 0.00 | 0.35 | 0.02 | 0.11 | 0.08 | 0.25 | 0.14 | 0.47 | 0.19 |
| AD01766 | 1.00 | 0.00 | 0.52 | 0.10 | 0.36 | 0.09 | 1.05 | 0.13 | 1.15 | 0.08 |
| AD01767 | 1.00 | 0.00 | 0.49 | 0.03 | 0.44 | 0.05 | 1.43 | 0.23 | 1.33 | 0.71 |
| AD01768 | 1.00 | 0.00 | 0.34 | 0.15 | 0.11 | 0.07 | 0.39 | 0.13 | 0.76 | 0.19 |
| AD01769 | 1.00 | 0.00 | 0.54 | 0.17 | 0.46 | 0.14 | 1.32 | 0.12 | 1.38 | 0.37 |
| AD01770 | 1.00 | 0.00 | 0.41 | 0.07 | 0.20 | 0.10 | 0.80 | 0.52 | 1.04 | 0.67 |

Example 12. In Vivo Testing of NAG-Conjugated LPA RNAi Agents in Apo(a) Tg Mice

NAG-conjugated LPA RNAi agents were administered to apo(a) Tg mice as described above. Each mouse received a single subcutaneous (SC) dose of either 10 mg/kg of LPA RNAi agent or saline. Human apo(a) (apo(a)) levels in serum were monitored for up to 22 days (Table 18). AD01765 showed the largest knockdown of apo(a) levels at day 8 with 96% knockdown, and >74% knockdown observed 3 weeks after dosing.

TABLE 18

Serum apo(a) protein levels in apo(a) Tg mice following SC administration of 10 mg/kg NAG-conjugated LPA RNAi agent. Apo(a) levels were normalized to day −1 and saline control.

| Treatment | Day −1 Ave | SD | Day 4 Ave | SD | Day 8 Ave | SD | Day 15 Ave | SD | Day 22 Ave | SD |
|---|---|---|---|---|---|---|---|---|---|---|
| Saline | 1.00 | 0.00 | 1.00 | 0.10 | 1.00 | 0.16 | 1.00 | 0.42 | 1.00 | 0.21 |
| AD01532 | 1.00 | 0.00 | 0.12 | 0.05 | 0.22 | 0.08 | 0.76 | 0.30 | 0.56 | 0.28 |
| AD01765 | 1.00 | 0.00 | 0.09 | 0.03 | 0.04 | 0.02 | 0.14 | 0.02 | 0.26 | 0.04 |
| AD01768 | 1.00 | 0.00 | 0.11 | 0.05 | 0.09 | 0.05 | 0.26 | 0.12 | 0.38 | 0.08 |

Example 13. In Vivo Testing of NAG-Conjugates LPA RNAi Agents in LPA Mc HTV Mice Indicated NAG-conjugated LPA RNAi agents were administered to LPA mc HTV mice as described above. Each mouse received a single subcutaneous (SC) dose of either 10 mg/kg of LPA RNAi agent or saline. Human apo(a) (apo(a)) levels in serum were analyzed at day 4 (Table 19). AD02001, AD01765 and AD01768 showed >90% knockdown at day 4.

TABLE 19

Serum apo(a) protein levels in LPA mc HTV mice following SC administration of 10 mg/kg NAG-conjugated LPA RNAi agent. Apo(a) levels were normalized to day −1 and saline control.

| Treatment | Prebleed | | Day 4 | |
| --- | --- | --- | --- | --- |
| | Ave | SD | Ave | SD |
| saline | 1.00 | 0.00 | 1.00 | 0.12 |
| AD01765 | 1.00 | 0.00 | 0.05 | 0.02 |
| AD01768 | 1.00 | 0.00 | 0.07 | 0.01 |
| AD01804 | 1.00 | 0.00 | 0.68 | 0.16 |
| AD02001 | 1.00 | 0.00 | 0.06 | 0.03 |

Figure 4:
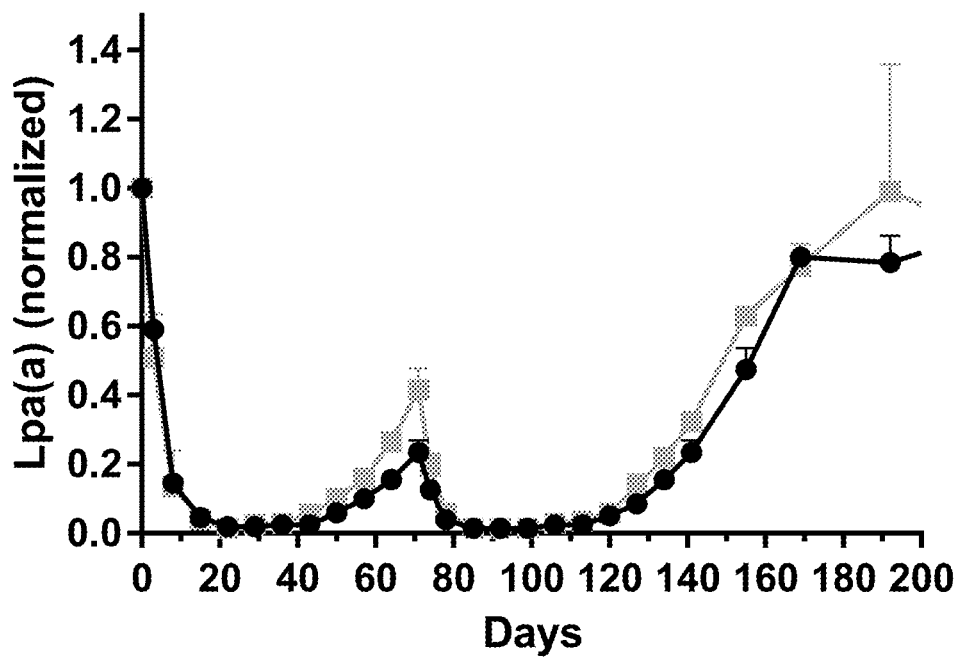
FIG. 4. Graph illustrating Lp(a) particle levels in Cynomolgus monkey serum following administration of 4 mg/kg or 6 mg/kg LPA RNAi agent dosed 1:1 (wt/wt) with delivery polymer on day 1 and day 71. Lp(a) levels were normalized to two pre-dose values (shown as day 0). 4 mg/kg dose=black circles; 6 mg/kg dose=gray squares.

Example 14. Apolipoprotein (a) (Apo(a)) Knockdown in Non-Human Primates Following LPA RNAi Agent Delivery by MLP Delivery Polymer MLP delivery polymer and LPA RNAi agent were made and combined in a pharmaceutically acceptable buffer. On day 1 and day 71, two cynomolgus macaque (*Macaca fascicularis*) primates were injected with either 4 mg/kg AD01196+4 mg/kg MLP delivery polymer or 6 mg/kg AD01196+6 mg/kg MLP delivery polymer. For each injection, the LPA RNAi agent+MLP delivery polymer was injected into the saphenous vein using a 22 to 25 gauge intravenous catheter. At the indicated time points (FIG. 4), blood samples were drawn and analyzed for apo(a) levels, lipid levels and toxicity markers as previously described. Significant knockdown of apo(a) was observed after the first dose with an average maximum knockdown of 96% for 4 mg/kg dose on day 15, and 96% for 6 mg/kg dose observed at day 15. Average maximum knockdown of Lp(a) after the first dose was 98.5% for 4 mg/kg dose on day 29, and 98.5% for 6 mg/kg dose on day 22. No dose-related toxicity was observed in treated animals.

Figure 2:
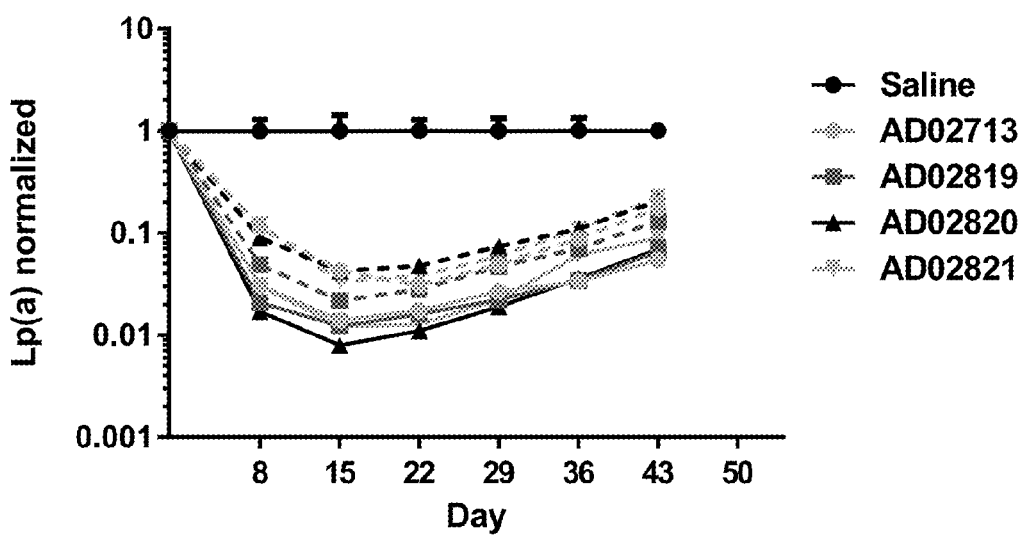
FIG. 2. Graph illustrating serum Lp(a) protein levels in Lp(a) Tg mice following administration of three subcutaneous doses of 1 mg/kg (dashed line) or 3 mg/kg (solid line) of indicated LPA RNAi agent, administered once a week for three weeks (dose on days 1, 8, and 15). Lp(a) levels were normalized to day 1 and saline control.

Example 15. In Vivo Testing of NAG-Conjugated LPA RNAi Agents in Lp(a) Tg Mice-Dose Response NAG-conjugated LPA RNAi agents were administered to Lp(a) Tg mice as described above. Each mouse received a single subcutaneous (SC) dose of either LPA RNAi agent at 0.5 mg/kg or 2 mg/kg dose levels or saline. Lp(a) levels in serum were monitored up to day 43 (FIG. 1, FIG. 2). All LPA RNAi agents showed dose-response with the higher doses showing greater knockdown with nadir between days 15 and 22.

Figure 5:
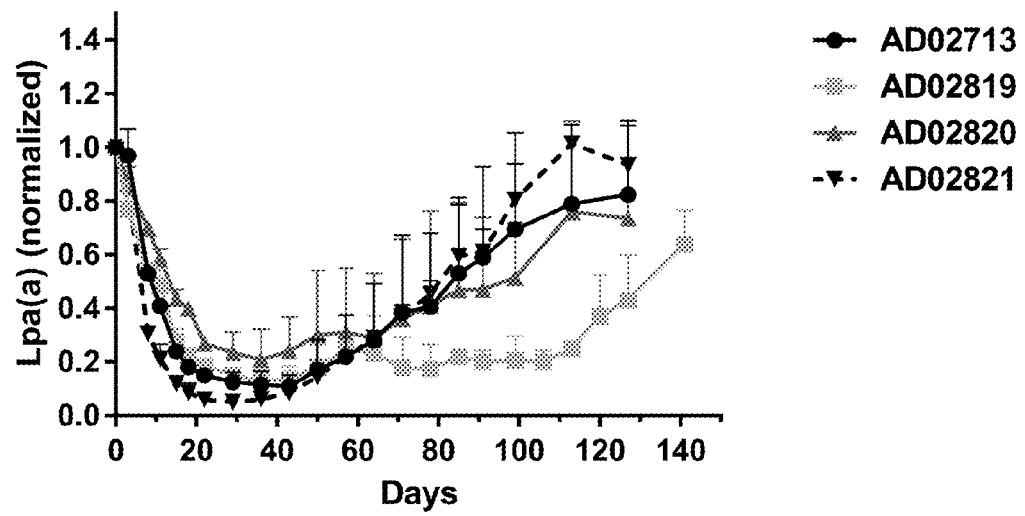
FIG. 5. Graph illustrating Lp(a) particle levels in Cynomolgus monkey serum following three weekly subcutaneous doses of 3 mg/kg of AD02819 LPA RNAi agent on days 1, 8, and 15. Lp(a) levels were normalized to three pre-dose values (shown as day 0).

Example 16. Apolipoprotein (a) (Apo(a)) Knockdown in Non-Human Primates Following Apo(a) Specific LPA RNAi Agent Molecule Delivery LPA RNAi agent was prepared in a pharmaceutically acceptable buffer as described herein for subcutaneous (SC) injection. On days 1, 7, and 15, two cynomolgus macaque (*Macaca fascicularis*) primates were injected subcutaneously with 3 mg/kg of AD02713, AD02819, AD02820, or AD02821. In addition, AD02819-treated monkeys were dosed again with 3 mg/kg of AD02819 on day 57 and day 85. Blood samples were drawn and analyzed for apo(a) levels, lipid levels and toxicity markers as previously described. Significant knockdown of Lp(a) was observed with an average maximum knockdown of 89% observed at day 43 for AD02713, 87% observed on day 36 for AD02819, 79% observed on day 36 for AD02820, and 95% observed on day 29 for AD02821 (FIG. 5). No dose-related toxicity was observed in treated animals over the time of the experiment.

Figure 6:
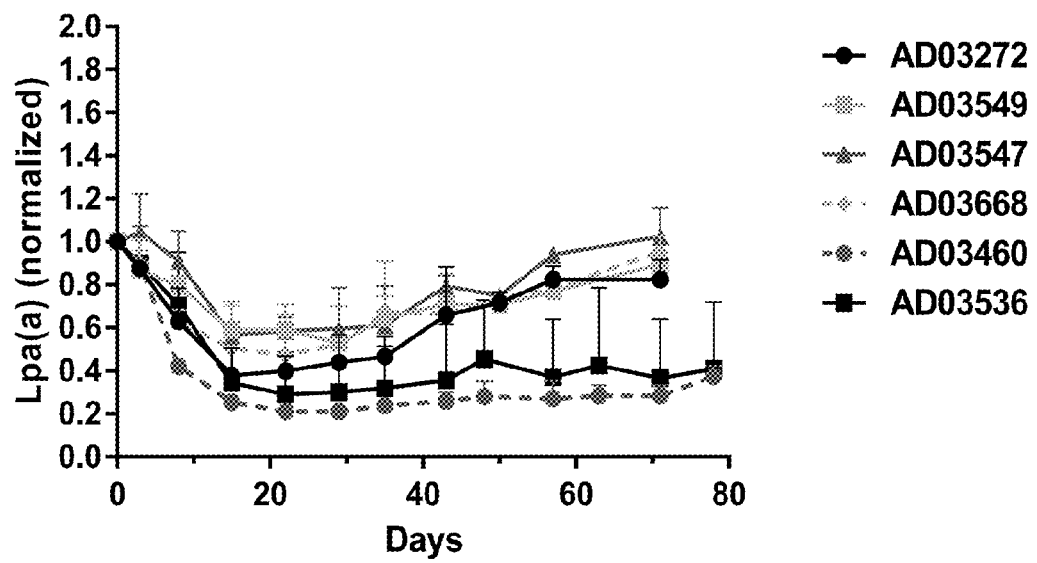
FIG. 6. Graph illustrating Lp(a) particle levels in Cynomolgus monkey serum following a single subcutaneous administration of 3 mg/kg of LPA RNAi agent on day 1. AD03460 and AD03536 groups received an additional 1 mg/kg dose of LPA RNAi agent on day 48. Lp(a) levels were normalized to three pre-dose values (shown as day 0).

Example 17. Apolipoprotein (a) (Apo(a)) Knockdown in Non-Human Primates Following LPA RNAi Agent Delivery LPA RNAi agent was prepared in a pharmaceutically acceptable buffer as described herein for subcutaneous (SC) injection. On day 1, two cynomolgus macaque (*Macaca fascicularis*) primates were injected subcutaneously with 3 mg/kg of AD03272, AD03462, AD03549, AD03547, AD03668, AD03460, or AD03536. In addition, AD03460 and AD03536-treated monkeys were dosed again with 1 mg/kg of the respective LPA RNAi agent on day 48. Blood samples were drawn and analyzed for apo(a) levels, lipid levels and toxicity markers as previously described. Significant knockdown of Lp(a) was observed with an average maximum knockdown of 62% for AD03272 on day 15, 28% for AD03462 on day 15, 47% for AD03549 on day 29, 44% for AD03547 on day 15, 53% for AD03668 on day 22, 79% for AD03460 on day 29, and 71% for AD03536 on day 22 (FIG. 6). No dose-related toxicity was observed in treated animals over the time of the experiment.

Example 18. Apolipoprotein (a) (Apo(a)) Knockdown in Primate Following Apo(a) Specific LPA RNAi Agent Molecule Delivery LPA RNAi agent was made and combined in a pharmaceutically acceptable buffer as described above for subcutaneous (SQ) injection. On day 1, cynomolgus macaque (*Macaca fascicularis*) primates were injected with subcutaneously with saline or 2 mg/kg of AD03460, AD03536, AD03851, AD03853, or AD04110. Blood samples were drawn and analyzed for apo(a) levels, lipid levels and toxicity markers on days 8 and 15 as previously described. Lp(a) levels were normalized to average of three predose values.

TABLE 20

Lipoprotein(a) levels in cynomolgus macaque primates following administration of either saline or 2 mg/kg AD03460, AD03536, AD03851, AD03853 or AD04110.

| | Normalized Lp(a) Day 8 | Normalized Lp(a) Day 15 |
| --- | --- | --- |
| Saline | 1.01 ± 0.06 | 1.15 ± 0.07 |
| AD03460 | 0.68 ± 0.12 | 0.40 ± 0.13 |
| AD03536 | 0.54 ± 0.07 | 0.21 ± 0.06 |
| AD03851 | 0.41 ± 0.08 | 0.18 ± 0.08 |
| AD03853 | 0.50 ± 0.23 | 0.27 ± 0.17 |
| AD04110 | 0.59 ± 0.13 | 0.43 ± 0.10 |

SEQUENCE LISTING (1285 sequences)

SEQ ID NO: 1 - DNA, 21 bp, artificial sequence
  LPA RNAi agent antisense strand
  modified_base 2-19: /mod_base = "2'-hydroxy nucleoside"
tcggcagucccuucugcgutt

SEQ ID NO: 2 - DNA, 21 bp, artificial sequence
  LPA RNAi agent antisense strand
  modified_base 2-19: /mod_base = "2'-hydroxy nucleoside"
tguagcacuccugcacccctt

SEQ ID NO: 3 - DNA, 21 bp, artificial sequence
  LPA RNAi agent antisense strand
  modified_base 2-19: /mod_base = "2'-hydroxy nucleoside"
taauaaggggcugccacagtt

SEQ ID NO: 4 - DNA, 21 bp, artificial sequence
  LPA RNAi agent antisense strand
  modified_base 2-19: /mod_base = "2'-hydroxy nucleoside"
tuaacaauaaggggcugcctt

SEQ ID NO: 5 - DNA, 21 bp, artificial sequence
  LPA RNAi agent antisense strand
  modified_base 2-19: /mod_base = "2'-hydroxy nucleoside"
tguauaacaauaaggggcutt

SEQ ID NO: 6 - DNA, 21 bp, artificial sequence
  LPA RNAi agent antisense strand
  modified_base 2-19: /mod_base = "2'-hydroxy nucleoside"
tcguauaacaauaaggggctt

SEQ ID NO: 7 - DNA, 21 bp, artificial sequence
  LPA RNAi agent antisense strand
  modified_base 2-19: /mod_base = "2'-hydroxy nucleoside"
tcgucugagcauugugucatt

SEQ ID NO: 8 - DNA, 21 bp, artificial sequence
  LPA RNAi agent antisense strand
  modified_base 2-19: /mod_base = "2'-hydroxy nucleoside"
tgcgucugagcauuguguctt

SEQ ID NO: 9 - DNA, 21 bp, artificial sequence
  LPA RNAi agent antisense strand
  modified_base 2-19: /mod_base = "2'-hydroxy nucleoside"
tugcgucugagcauugugutt

SEQ ID NO: 10 - DNA, 21 bp, artificial sequence
  LPA RNAi agent antisense strand
  modified_base 2-19: /mod_base = "2'-hydroxy nucleoside"
tucugcgucugagcauugutt

SEQ ID NO: 11 - DNA, 21 bp, artificial sequence
  LPA RNAi agent antisense strand
  modified_base 2-19: /mod_base = "2'-hydroxy nucleoside"
tggaucuggauuucggcagtt

SEQ ID NO: 12 - DNA, 21 bp, artificial sequence
  LPA RNAi agent antisense strand
  modified_base 2-19: /mod_base = "2'-hydroxy nucleoside"
tcaggaucuggauuucggctt

SEQ ID NO: 13 - DNA, 21 bp, artificial sequence
  LPA RNAi agent antisense strand
  modified_base 2-19: /mod_base = "2'-hydroxy nucleoside"
tcaucugagcaucgugucatt

SEQ ID NO: 14 - DNA, 21 bp, artificial sequence
  LPA RNAi agent antisense strand
  modified_base 2-19: /mod_base = "2'-hydroxy nucleoside"
tgcaucugagcaucguguctt

SEQ ID NO: 15 - DNA, 21 bp, artificial sequence
  LPA RNAi agent antisense strand
  modified_base 2-19: /mod_base = "2'-hydroxy nucleoside"
tugcaucugagcaucgugutt

SEQ ID NO: 16 - DNA, 21 bp, artificial sequence
  LPA RNAi agent antisense strand
  modified_base 2-19: /mod_base = "2'-hydroxy nucleoside"
tucugcaucugagcaucgutt

SEQ ID NO: 17 - DNA, 21 bp, artificial sequence
  LPA RNAi agent antisense strand
  modified_base 2-19: /mod_base = "2'-hydroxy nucleoside"
taaagccucuaggcuuggatt

SEQ ID NO: 18 - DNA, 21 bp, artificial sequence
  LPA RNAi agent antisense strand
  modified_base 2-19: /mod_base = "2'-hydroxy nucleoside"
tguaccccggggguuuccutt

SEQ ID NO: 19 - DNA, 21 bp, artificial sequence
  LPA RNAi agent antisense strand
  modified_base 2-19: /mod_base = "2'-hydroxy nucleoside"
tuguaccccggggguuucctt

SEQ ID NO: 20 - DNA, 21 bp, artificial sequence
  LPA RNAi agent antisense strand
  modified_base 2-19: /mod_base = "2'-hydroxy nucleoside"
tcuguaccccggggguuuctt

SEQ ID NO: 21 - DNA, 21 bp, artificial sequence
  LPA RNAi agent antisense strand
  modified_base 2-19: /mod_base = "2'-hydroxy nucleoside"
tuccauaaugguaguagcatt

SEQ ID NO: 22 - DNA, 21 bp, artificial sequence
  LPA RNAi agent antisense strand
  modified_base 2-19: /mod_base = "2'-hydroxy nucleoside"
tguccauaaugguaguagctt

SEQ ID NO: 23 - DNA, 21 bp, artificial sequence
  LPA RNAi agent antisense strand
  modified_base 2-19: /mod_base = "2'-hydroxy nucleoside"
tcucuguccauaaugguagtt

SEQ ID NO: 24 - DNA, 21 bp, artificial sequence
  LPA RNAi agent antisense strand
  modified_base 2-19: /mod_base = "2'-hydroxy nucleoside"
tcgacuaugcugguguggutt

SEQ ID NO: 25 - DNA, 21 bp, artificial sequence
  LPA RNAi agent antisense strand
  modified_base 2-19: /mod_base = "2'-hydroxy nucleoside"
tccgacuaugcugguguggtt

SEQ ID NO: 26 - DNA, 21 bp, artificial sequence
  LPA RNAi agent antisense strand
  modified_base 2-19: /mod_base = "2'-hydroxy nucleoside"
tuccgacuaugcuggugugtt

SEQ ID NO: 27 - DNA, 21 bp, artificial sequence
  LPA RNAi agent antisense strand
  modified_base 2-19: /mod_base = "2'-hydroxy nucleoside"
tgguccgacuaugcuggugtt

SEQ ID NO: 28 - DNA, 21 bp, artificial sequence
  LPA RNAi agent antisense strand
  modified_base 2-19: /mod_base = "2'-hydroxy nucleoside"
tuuucugggguccgacuautt

SEQ ID NO: 29 - DNA, 21 bp, artificial sequence
  LPA RNAi agent antisense strand
  modified_base 2-19: /mod_base = "2'-hydroxy nucleoside"
tuuuucugggguccgacuatt

SEQ ID NO: 30 - DNA, 21 bp, artificial sequence
  LPA RNAi agent antisense strand
  modified_base 2-19: /mod_base = "2'-hydroxy nucleoside"
tgcgaaucucagcaucuggtt

SEQ ID NO: 31 - DNA, 21 bp, artificial sequence
  LPA RNAi agent antisense strand
  modified_base 2-19: /mod_base = "2'-hydroxy nucleoside"
tccaagggcgaaucucagctt

SEQ ID NO: 32 - DNA, 21 bp, artificial sequence
  LPA RNAi agent antisense strand
  modified_base 2-19: /mod_base = "2'-hydroxy nucleoside"
taccaagggcgaaucucagtt

SEQ ID NO: 33 - DNA, 21 bp, artificial sequence
  LPA RNAi agent antisense strand
  modified_base 2-19: /mod_base = "2'-hydroxy nucleoside"
tcaccaagggcgaaucucatt

SEQ ID NO: 34 - DNA, 21 bp, artificial sequence
  LPA RNAi agent antisense strand
  modified_base 2-19: /mod_base = "2'-hydroxy nucleoside"
tacaccaagggcgaaucuctt

SEQ ID NO: 35 - DNA, 21 bp, artificial sequence
  LPA RNAi agent antisense strand
  modified_base 2-19: /mod_base = "2'-hydroxy nucleoside"
tccugacacugggauccautt

SEQ ID NO: 36 - DNA, 21 bp, artificial sequence
  LPA RNAi agent antisense strand
  modified_base 2-19: /mod_base = "2'-hydroxy nucleoside"
tugcaaggacacuugauuctt

SEQ ID NO: 37 - DNA, 21 bp, artificial sequence
  LPA RNAi agent antisense strand
  modified_base 2-19: /mod_base = "2'-hydroxy nucleoside"
tuugcaaggacacuugauutt

SEQ ID NO: 38 - DNA, 21 bp, artificial sequence
  LPA RNAi agent antisense strand
  modified_base 2-19: /mod_base = "2'-hydroxy nucleoside"
tuugcuccguuggugcuuctt

SEQ ID NO: 39 - DNA, 21 bp, artificial sequence
  LPA RNAi agent antisense strand
  modified_base 2-19: /mod_base = "2'-hydroxy nucleoside"
taaugagccucgauaacuctt

SEQ ID NO: 40 - DNA, 21 bp, artificial sequence
  LPA RNAi agent antisense strand
  modified_base 2-19: /mod_base = "2'-hydroxy nucleoside"
tgaaugagccucgauaacutt

SEQ ID NO: 41 - DNA, 21 bp, artificial sequence
  LPA RNAi agent antisense strand
  modified_base 2-19: /mod_base = "2'-hydroxy nucleoside"
tggauaauauucuguuguctt

SEQ ID NO: 42 - DNA, 21 bp, artificial sequence
  LPA RNAi agent antisense strand
  modified_base 2-19: /mod_base = "2'-hydroxy nucleoside"
tccaugguauaacaccaagtt

SEQ ID NO: 43 - DNA, 21 bp, artificial sequence
  LPA RNAi agent antisense strand
  modified_base 2-19: /mod_base = "2'-hydroxy nucleoside"
tgauccaugguauaacacctt

SEQ ID NO: 44 - DNA, 21 bp, artificial sequence
  LPA RNAi agent antisense strand
  modified_base 2-19: /mod_base = "2'-hydroxy nucleoside"
tauugggauccaugguauatt

SEQ ID NO: 45 - DNA, 21 bp, artificial sequence
  LPA RNAi agent antisense strand
  modified_base 2-19: /mod_base = "2'-hydroxy nucleoside"
tcauugggauccaugguautt

SEQ ID NO: 46 - DNA, 21 bp, artificial sequence
  LPA RNAi agent antisense strand
  modified_base 2-19: /mod_base = "2'-hydroxy nucleoside"
tacauugggauccaugguatt

SEQ ID NO: 47 - DNA, 21 bp, artificial sequence
  LPA RNAi agent antisense strand
  modified_base 2-19: /mod_base = "2'-hydroxy nucleoside"
tgacauugggauccauggutt

SEQ ID NO: 48 - DNA, 21 bp, artificial sequence
  LPA RNAi agent antisense strand
  modified_base 2-19: /mod_base = "2'-hydroxy nucleoside"
tgacauugugucagguugctt

SEQ ID NO: 49 - DNA, 21 bp, artificial sequence
  LPA RNAi agent antisense strand
  modified_base 2-19: /mod_base = "2'-hydroxy nucleoside"
tcacuggacauugugucagtt

SEQ ID NO: 50 - DNA, 21 bp, artificial sequence
  LPA RNAi agent antisense strand
  modified_base 2-19: /mod_base = "2'-hydroxy nucleoside"
tacuugauucugucacuggtt

SEQ ID NO: 51 - DNA, 21 bp, artificial sequence
  LPA RNAi agent antisense strand
  modified_base 2-19: /mod_base = "2'-hydroxy nucleoside"
tgagaaugagccucgauaatt

SEQ ID NO: 52 - DNA, 21 bp, artificial sequence
  LPA RNAi agent antisense strand
  modified_base 2-19: /mod_base = "2'-hydroxy nucleoside"
tccauuuggguaguauucutt

SEQ ID NO: 53 - DNA, 21 bp, artificial sequence
  LPA RNAi agent antisense strand
  modified_base 2-19: /mod_base = "2'-hydroxy nucleoside"
tcaccauuuggguaguauutt

SEQ ID NO: 54 - DNA, 21 bp, artificial sequence
  LPA RNAi agent antisense strand
  modified_base 2-19: /mod_base = "2'-hydroxy nucleoside"
tccaccauuuggguaguautt

SEQ ID NO: 55 - DNA, 21 bp, artificial sequence
  LPA RNAi agent antisense strand
  modified_base 2-19: /mod_base = "2'-hydroxy nucleoside"
tauaacaccaagggcgaautt

SEQ ID NO: 56 - DNA, 21 bp, artificial sequence
  LPA RNAi agent antisense strand
  modified_base 2-19: /mod_base = "2'-hydroxy nucleoside"
tacugggauccaugguauatt

SEQ ID NO: 57 - DNA, 21 bp, artificial sequence
  LPA RNAi agent antisense strand
  modified_base 2-19: /mod_base = "2'-hydroxy nucleoside"
tcacugggauccaugguautt

SEQ ID NO: 58 - DNA, 21 bp, artificial sequence
  LPA RNAi agent antisense strand
  modified_base 2-19: /mod_base = "2'-hydroxy nucleoside"
taccaccgugggaguugugtt

SEQ ID NO: 59 - DNA, 21 bp, artificial sequence
  LPA RNAi agent antisense strand
  modified_base 2-19: /mod_base = "2'-hydroxy nucleoside"
tcaagacugacauguucuutt

SEQ ID NO: 60 - DNA, 21 bp, artificial sequence
  LPA RNAi agent antisense strand
  modified_base 2-19: /mod_base = "2'-hydroxy nucleoside"
tgggaguugugaggacacutt

SEQ ID NO: 61 - DNA, 21 bp, artificial sequence
  LPA RNAi agent antisense strand
  modified_base 2-19: /mod_base = "2'-hydroxy nucleoside"
tucucagguggugcuuguutt

SEQ ID NO: 62 - DNA, 21 bp, artificial sequence
  LPA RNAi agent antisense strand
  modified_base 2-19: /mod_base = "2'-hydroxy nucleoside"
tcacagggcuuuucucaggtt

SEQ ID NO: 63 - DNA, 21 bp, artificial sequence
  LPA RNAi agent antisense strand
  modified_base 2-19: /mod_base = "2'-hydroxy nucleoside"
tgaugccagugugguaucatt

SEQ ID NO: 64 - DNA, 21 bp, artificial sequence
  LPA RNAi agent antisense strand
  modified_base 2-19: /mod_base = "2'-hydroxy nucleoside"
tugaugccagugugguauctt

SEQ ID NO: 65 - DNA, 21 bp, artificial sequence
  LPA RNAi agent antisense strand
  modified_base 2-19: /mod_base = "2'-hydroxy nucleoside"
tgacaccugauucuguuuctt

SEQ ID NO: 66 - DNA, 21 bp, artificial sequence
  LPA RNAi agent antisense strand
  modified_base 2-19: /mod_base = "2'-hydroxy nucleoside"
tggacaccugauucuguuutt

SEQ ID NO: 67 - DNA, 21 bp, artificial sequence
  LPA RNAi agent antisense strand
  modified_base 2-19: /mod_base = "2'-hydroxy nucleoside"
tcuaggacaccugauucugtt

SEQ ID NO: 68 - DNA, 21 bp, artificial sequence
  LPA RNAi agent antisense strand
  modified_base 2-19: /mod_base = "2'-hydroxy nucleoside"
tauaaggggcugccacaggtt

SEQ ID NO: 69 - DNA, 21 bp, artificial sequence
  LPA RNAi agent antisense strand
  modified_base 2-19: /mod_base = "2'-hydroxy nucleoside"
taacaauaaggggcugccatt

SEQ ID NO: 70 - DNA, 21 bp, artificial sequence
  LPA RNAi agent antisense strand
  modified_base 2-19: /mod_base = "2'-hydroxy nucleoside"
tguccgacuaugcuggugutt

SEQ ID NO: 71 - DNA, 21 bp, artificial sequence
  LPA RNAi agent antisense strand
  modified_base 2-19: /mod_base = "2'-hydroxy nucleoside"
tucucagcaucuggauucctt

SEQ ID NO: 72 - DNA, 21 bp, artificial sequence
  LPA RNAi agent antisense strand
  modified_base 2-19: /mod_base = "2'-hydroxy nucleoside"
tcgaaucucagcaucuggatt

SEQ ID NO: 73 - DNA, 21 bp, artificial sequence
  LPA RNAi agent antisense strand
  modified_base 2-19: /mod_base = "2'-hydroxy nucleoside"
taagggcgaaucucagcautt

SEQ ID NO: 74 - DNA, 21 bp, artificial sequence
  LPA RNAi agent antisense strand
  modified_base 2-19: /mod_base = "2'-hydroxy nucleoside"
tugacacugggauccauggtt

SEQ ID NO: 75 - DNA, 21 bp, artificial sequence
  LPA RNAi agent antisense strand
  modified_base 2-19: /mod_base = "2'-hydroxy nucleoside"
tccguuggugcuucuucagtt

SEQ ID NO: 76 - DNA, 21 bp, artificial sequence
  LPA RNAi agent antisense strand
  modified_base 2-19: /mod_base = "2'-hydroxy nucleoside"
tcuugauucugucacuggatt

SEQ ID NO: 77 - DNA, 21 bp, artificial sequence
  LPA RNAi agent antisense strand
  modified_base 2-19: /mod_base = "2'-hydroxy nucleoside"
tcaccgugggaguugugagtt

SEQ ID NO: 78 - DNA, 21 bp, artificial sequence
  LPA RNAi agent antisense strand
  modified_base 2-19: /mod_base = "2'-hydroxy nucleoside"
tucuaggacaccugauucutt

SEQ ID NO: 79 - DNA, 21 bp, artificial sequence
  LPA RNAi agent antisense strand
  modified_base 2-19: /mod_base = "2'-hydroxy nucleoside"
tagucucuaggacaccugatt

SEQ ID NO: 80 - DNA, 21 bp, artificial sequence
  LPA RNAi agent antisense strand
  modified_base 2-19: /mod_base = "2'-hydroxy nucleoside"
tcaauaaggggcugccacatt

SEQ ID NO: 81 - DNA, 21 bp, artificial sequence
  LPA RNAi agent antisense strand
  modified_base 2-19: /mod_base = "2'-hydroxy nucleoside"
tcugcgucugagcauugugtt

SEQ ID NO: 82 - DNA, 21 bp, artificial sequence
  LPA RNAi agent antisense strand
  modified_base 2-19: /mod_base = "2'-hydroxy nucleoside"
tacaggaucuggauuucggtt

SEQ ID NO: 83 - DNA, 21 bp, artificial sequence
  LPA RNAi agent antisense strand
  modified_base 2-19: /mod_base = "2'-hydroxy nucleoside"
tccggggguuuccucaguctt

SEQ ID NO: 84 - DNA, 21 bp, artificial sequence
  LPA RNAi agent antisense strand
  modified_base 2-19: /mod_base = "2'-hydroxy nucleoside"
tuguccauaaugguaguagtt

SEQ ID NO: 85 - DNA, 21 bp, artificial sequence
  LPA RNAi agent antisense strand
  modified_base 2-19: /mod_base = "2'-hydroxy nucleoside"
tucuguccauaaugguagutt

SEQ ID NO: 86 - DNA, 21 bp, artificial sequence
  LPA RNAi agent antisense strand
  modified_base 2-19: /mod_base = "2'-hydroxy nucleoside"
tacucuguccauaaugguatt

SEQ ID NO: 87 - DNA, 21 bp, artificial sequence
  LPA RNAi agent antisense strand
  modified_base 2-19: /mod_base = "2'-hydroxy nucleoside"
taacucuguccauaauggutt

SEQ ID NO: 88 - DNA, 21 bp, artificial sequence
  LPA RNAi agent antisense strand
  modified_base 2-19: /mod_base = "2'-hydroxy nucleoside"
tgggcgaaucucagcaucutt

SEQ ID NO: 89 - DNA, 21 bp, artificial sequence
  LPA RNAi agent antisense strand
  modified_base 2-19: /mod_base = "2'-hydroxy nucleoside"
tagggcgaaucucagcauctt

SEQ ID NO: 90 - DNA, 21 bp, artificial sequence
  LPA RNAi agent antisense strand
  modified_base 2-19: /mod_base = "2'-hydroxy nucleoside"
taacaccaagggcgaaucutt

SEQ ID NO: 91 - DNA, 21 bp, artificial sequence
  LPA RNAi agent antisense strand
  modified_base 2-19: /mod_base = "2'-hydroxy nucleoside"
taggacacuugauucuguctt

SEQ ID NO: 92 - DNA, 21 bp, artificial sequence
  LPA RNAi agent antisense strand
  modified_base 2-19: /mod_base = "2'-hydroxy nucleoside"
tggaccaagacugacaugutt

SEQ ID NO: 93 - DNA, 21 bp, artificial sequence
  LPA RNAi agent antisense strand
  modified_base 2-19: /mod_base = "2'-hydroxy nucleoside"
tggucaggccaccauuuggtt

SEQ ID NO: 94 - DNA, 21 bp, artificial sequence
  LPA RNAi agent antisense strand
  modified_base 2-19: /mod_base = "2'-hydroxy nucleoside"
tauccaugguauaacaccatt

SEQ ID NO: 95 - DNA, 21 bp, artificial sequence
  LPA RNAi agent antisense strand
  modified_base 2-19: /mod_base = "2'-hydroxy nucleoside"
tgggauccaugguauaacatt

SEQ ID NO: 96 - DNA, 21 bp, artificial sequence
  LPA RNAi agent antisense strand
  modified_base 2-19: /mod_base = "2'-hydroxy nucleoside"
tuggacauugugucagguutt

SEQ ID NO: 97 - DNA, 21 bp, artificial sequence
  LPA RNAi agent antisense strand
  modified_base 2-19: /mod_base = "2'-hydroxy nucleoside"
tauucugucacuggacauutt

SEQ ID NO: 98 - DNA, 21 bp, artificial sequence
  LPA RNAi agent antisense strand
  modified_base 2-19: /mod_base = "2'-hydroxy nucleoside"
tggugcuuguucagaaacatt

SEQ ID NO: 99 - DNA, 21 bp, artificial sequence
  LPA RNAi agent antisense strand
  modified_base 2-19: /mod_base = "2'-hydroxy nucleoside"
tggagaaugagccucgauatt

SEQ ID NO: 100 - DNA, 21 bp, artificial sequence
  LPA RNAi agent antisense strand
  modified_base 2-19: /mod_base = "2'-hydroxy nucleoside"
tguggagaaugagccucgatt

SEQ ID NO: 101 - DNA, 21 bp, artificial sequence
  LPA RNAi agent antisense strand
  modified_base 2-19: /mod_base = "2'-hydroxy nucleoside"
tccgugggaguugugaggatt

SEQ ID NO: 102 - DNA, 21 bp, artificial sequence
  LPA RNAi agent antisense strand
  modified_base 2-19: /mod_base = "2'-hydroxy nucleoside"
tggaccaccgugggaguugtt

SEQ ID NO: 103 - DNA, 21 bp, artificial sequence
  LPA RNAi agent antisense strand
  modified_base 2-19: /mod_base = "2'-hydroxy nucleoside"
tugcuuguucagaaggagctt

SEQ ID NO: 104 - DNA, 21 bp, artificial sequence
  LPA RNAi agent antisense strand
  modified_base 2-19: /mod_base = "2'-hydroxy nucleoside"
tcugaugccagugugguautt

SEQ ID NO: 105 - DNA, 21 bp, artificial sequence
  LPA RNAi agent antisense strand
  modified_base 2-19: /mod_base = "2'-hydroxy nucleoside"
tuaggacaccugauucugutt

SEQ ID NO: 106 - DNA, 21 bp, artificial sequence
  LPA RNAi agent antisense strand
  modified_base 2-19: /mod_base = "2'-hydroxy nucleoside"
tcucuaggacaccugauuctt

SEQ ID NO: 107 - DNA, 21 bp, artificial sequence
  LPA RNAi agent antisense strand
  modified_base 2-19: /mod_base = "2'-hydroxy nucleoside"
tucucuaggacaccugauutt

SEQ ID NO: 108 - DNA, 21 bp, artificial sequence
  LPA RNAi agent antisense strand
  modified_base 2-19: /mod_base = "2'-hydroxy nucleoside"
tgucucuaggacaccugautt

SEQ ID NO: 109 - DNA, 26 bp, artificial sequence
  LPA RNAi agent antisense strand
  modified_base 2-26: /mod_base = "2'-hydroxy nucleoside"
tgagaaugagccucgauaacucuuau

SEQ ID NO: 110 - DNA, 26 bp, artificial sequence
  LPA RNAi agent antisense strand
  modified_base 2-26: /mod_base = "2'-hydroxy nucleoside"
tgacaccugauucuguuucugaguau

SEQ ID NO: 111 - DNA, 26 bp, artificial sequence
  LPA RNAi agent antisense strand
  modified_base 2-26: /mod_base = "2'-hydroxy nucleoside"
tcguauaacaauaaggggcugccuau

SEQ ID NO: 112 - DNA, 26 bp, artificial sequence
  LPA RNAi agent antisense strand
  modified_base 2-26: /mod_base = "2'-hydroxy nucleoside"
tgcgucugagcauugugucagguuau

SEQ ID NO: 113 - DNA, 26 bp, artificial sequence
  LPA RNAi agent antisense strand
  modified_base 2-26: /mod_base = "2'-hydroxy nucleoside"
tugcgucugagcauugugucagguau

SEQ ID NO: 114 - DNA, 26 bp, artificial sequence
  LPA RNAi agent antisense strand
  modified_base 2-26: /mod_base = "2'-hydroxy nucleoside"
taagggcgaaucucagcaucugguau

SEQ ID NO: 115 - RNA, 18 nt, artificial sequence
  LPA RNAi agent antisense strand
uuaacaauaaggggcugc

SEQ ID NO: 116 - RNA, 18 nt, artificial sequence
  LPA RNAi agent antisense strand
uguauaacaauaaggggc

SEQ ID NO: 117 - RNA, 18 nt, artificial sequence
  LPA RNAi agent antisense strand
ucguauaacaauaagggg

SEQ ID NO: 118 - RNA, 18 nt, artificial sequence
  LPA RNAi agent antisense strand
ugcgucugagcauugugu

SEQ ID NO: 119 - RNA, 18 nt, artificial sequence
  LPA RNAi agent antisense strand
uugcgucugagcauugug

SEQ ID NO: 120 - RNA, 18 nt, artificial sequence
  LPA RNAi agent antisense strand
ucaggaucuggauuucgg

SEQ ID NO: 121 - RNA, 18 nt, artificial sequence
  LPA RNAi agent antisense strand
uugcaucugagcaucgug

SEQ ID NO: 122 - RNA, 18 nt, artificial sequence
  LPA RNAi agent antisense strand
ucgacuaugcuggugugg

SEQ ID NO: 123 - RNA, 18 nt, artificial sequence
  LPA RNAi agent antisense strand
uuuucugggguccgacua

SEQ ID NO: 124 - RNA, 18 nt, artificial sequence
  LPA RNAi agent antisense strand
ugcgaaucucagcaucug

SEQ ID NO: 125 - RNA, 18 nt, artificial sequence
  LPA RNAi agent antisense strand
uugcaaggacacuugauu

SEQ ID NO: 126 - RNA, 18 nt, artificial sequence
  LPA RNAi agent antisense strand
uaaugagccucgauaacu

SEQ ID NO: 127 - RNA, 18 nt, artificial sequence
  LPA RNAi agent antisense strand
ugaaugagccucgauaac

SEQ ID NO: 128 - RNA, 18 nt, artificial sequence
  LPA RNAi agent antisense strand
ugacauugugucagguug

SEQ ID NO: 129 - RNA, 18 nt, artificial sequence
  LPA RNAi agent antisense strand
ugagaaugagccucgaua

SEQ ID NO: 130 - RNA, 18 nt, artificial sequence
  LPA RNAi agent antisense strand
uccauuuggguaguauuc

SEQ ID NO: 131 - RNA, 18 nt, artificial sequence
  LPA RNAi agent antisense strand
ucaccauuuggguaguau

SEQ ID NO: 132 - RNA, 18 nt, artificial sequence
  LPA RNAi agent antisense strand
ugacaccugauucuguuu

SEQ ID NO: 133 - RNA, 18 nt, artificial sequence
  LPA RNAi agent antisense strand
uggacaccugauucuguu

SEQ ID NO: 134 - RNA, 17 nt, artificial sequence
  LPA RNAi agent antisense strand
uuaacaauaaggggcug

SEQ ID NO: 135 - RNA, 17 nt, artificial sequence
  LPA RNAi agent antisense strand
uguauaacaauaagggg

SEQ ID NO: 136 - RNA, 17 nt, artificial sequence
  LPA RNAi agent antisense strand
ucguauaacaauaaggg

SEQ ID NO: 137 - RNA, 17 nt, artificial sequence
  LPA RNAi agent antisense strand
ugcgucugagcauugug

SEQ ID NO: 138 - RNA, 17 nt, artificial sequence
  LPA RNAi agent antisense strand
uugcgucugagcauugu

SEQ ID NO: 139 - RNA, 17 nt, artificial sequence
  LPA RNAi agent antisense strand
ucaggaucuggauuucg

SEQ ID NO: 140 - RNA, 17 nt, artificial sequence
  LPA RNAi agent antisense strand
uugcaucugagcaucgu

SEQ ID NO: 141 - RNA, 17 nt, artificial sequence
  LPA RNAi agent antisense strand
ucgacuaugcuggugug

SEQ ID NO: 142 - RNA, 17 nt, artificial sequence
  LPA RNAi agent antisense strand
uuuucugggguccgacu

SEQ ID NO: 143 - RNA, 17 nt, artificial sequence
  LPA RNAi agent antisense strand
ugcgaaucucagcaucu

SEQ ID NO: 144 - RNA, 17 nt, artificial sequence
  LPA RNAi agent antisense strand
uugcaaggacacuugau

SEQ ID NO: 145 - RNA, 17 nt, artificial sequence
  LPA RNAi agent antisense strand
uaaugagccucgauaac

SEQ ID NO: 146 - RNA, 17 nt, artificial sequence
  LPA RNAi agent antisense strand
ugaaugagccucgauaa

SEQ ID NO: 147 - RNA, 17 nt, artificial sequence
  LPA RNAi agent antisense strand
ugacauugugucagguu

SEQ ID NO: 148 - RNA, 17 nt, artificial sequence
  LPA RNAi agent antisense strand
ugagaaugagccucgau

SEQ ID NO: 149 - RNA, 17 nt, artificial sequence
  LPA RNAi agent antisense strand
uccauuuggguaguauu

SEQ ID NO: 150 - RNA, 17 nt, artificial sequence
  LPA RNAi agent antisense strand
ucaccauuuggguagua

SEQ ID NO: 151 - RNA, 17 nt, artificial sequence
  LPA RNAi agent antisense strand
ugacaccugauucuguu

SEQ ID NO: 152 - RNA, 17 nt, artificial sequence
  LPA RNAi agent antisense strand
uggacaccugauucugu

SEQ ID NO: 153 - RNA, 26 nt, artificial sequence
  LPA RNAi agent antisense strand
ugagaaugagccucgauaacucuuau

SEQ ID NO: 154 - RNA, 26 nt, artificial sequence
  LPA RNAi agent antisense strand
ugacaccugauucuguuucugaguau

SEQ ID NO: 155 - DNA, 26 bp, artificial sequence
  LPA RNAi agent antisense strand
  modified_base 1-22,24-26: /mod_base = "2'-hydroxy nucleoside"
ugagaaugagccucgauaacuctuau

SEQ ID NO: 156 - RNA, 26 nt, artificial sequence
  LPA RNAi agent antisense strand
ucguauaacaauaaggggcugccuau

SEQ ID NO: 157 - DNA, 21 bp, artificial sequence
  LPA RNAi agent antisense strand
  modified_base 1-19: /mod_base = "2'-hydroxy nucleoside"
ugagaaugagccucgauaatt

SEQ ID NO: 158 - RNA, 26 nt, artificial sequence
  LPA RNAi agent antisense strand
ucguauaacaauaaggcgcugccuau

SEQ ID NO: 159 - DNA, 17 bp, artificial sequence
  LPA RNAi agent antisense strand
  modified_base 1-16: /mod_base = "2'-hydroxy nucleoside"
ugagaaugagccucgat

SEQ ID NO: 160 - DNA, 17 bp, artificial sequence
  LPA RNAi agent antisense strand
  modified_base 1-15: /mod_base = "2'-hydroxy nucleoside"
ugacaccugauucugtt

SEQ ID NO: 161 - RNA, 24 nt, artificial sequence
  LPA RNAi agent antisense strand
ucguauaacaauaaggggcugauu

SEQ ID NO: 162 - RNA, 24 nt, artificial sequence
  LPA RNAi agent antisense strand
ucguauaacaauaaggggcugcuu

SEQ ID NO: 163 - RNA, 24 nt, artificial sequence
  LPA RNAi agent antisense strand
ugagaaugagccucgauaacucuu

SEQ ID NO: 164 - RNA, 21 nt, artificial sequence
  LPA RNAi agent antisense strand
ucguauaacaauaaggggcuu

SEQ ID NO: 165 - RNA, 17 nt, artificial sequence
  LPA RNAi agent antisense strand
uguauaacaauaagggg

SEQ ID NO: 166 - RNA, 17 nt, artificial sequence
  LPA RNAi agent antisense strand
ucguauaacaauaaggg

SEQ ID NO: 167 - DNA, 17 bp, artificial sequence
  LPA RNAi agent antisense strand
  modified_base 1-16: /mod_base = "2'-hydroxy nucleoside"
ugagaaugagccucgat

SEQ ID NO: 168 - DNA, 17 bp, artificial sequence
  LPA RNAi agent antisense strand
  modified_base 1-15: /mod_base = "2'-hydroxy nucleoside"
ugacaccugauucugtt

SEQ ID NO: 169 - DNA, 26 bp, artificial sequence
  LPA RNAi agent antisense strand
  modified_base 2-26: /mod_base = "2'-hydroxy nucleoside"
tucguauaacaauaaggggcugccua

SEQ ID NO: 170 - RNA, 26 nt, artificial sequence
  LPA RNAi agent antisense strand
uaucguauaacaauaaggggcugccu

SEQ ID NO: 171 - DNA, 26 bp, artificial sequence
  LPA RNAi agent antisense strand
  modified_base 2-26: /mod_base = "2'-hydroxy nucleoside"
tccguauaacaauaaggggcugccua

SEQ ID NO: 172 - RNA, 26 nt, artificial sequence
  LPA RNAi agent antisense strand
cuccguauaacaauaaggggcugccu

SEQ ID NO: 173 - DNA, 26 bp, artificial sequence
  LPA RNAi agent antisense strand
  modified_base 2-26: /mod_base = "2'-hydroxy nucleoside"
tugagaaugagccucgauaacucuua

SEQ ID NO: 174 - RNA, 26 nt, artificial sequence
  LPA RNAi agent antisense strand
uaugagaaugagccucgauaacucuu

SEQ ID NO: 175 - DNA, 26 bp, artificial sequence
  LPA RNAi agent antisense strand
  modified_base 2-26: /mod_base = "2'-hydroxy nucleoside"
tggagaaugagccucgauaacucuua

SEQ ID NO: 176 - RNA, 26 nt, artificial sequence
  LPA RNAi agent antisense strand
guggagaaugagccucgauaacucuu

SEQ ID NO: 177 - RNA, 21 nt, artificial sequence
  LPA RNAi agent antisense strand
ugagaaugagccucgauaauu

SEQ ID NO: 178 - DNA, 21 bp, artificial sequence
  LPA RNAi agent antisense strand
  modified_base 2-21: /mod_base = "2'-hydroxy nucleoside"
tcguauaacaauaaggggcuu

SEQ ID NO: 179 - RNA, 26 nt, artificial sequence
  LPA RNAi agent antisense strand
ugagaaugagccucgauaauuauaua

SEQ ID NO: 180 - RNA, 23 nt, artificial sequence
  LPA RNAi agent antisense strand
ucguauaacaauaaggggcugcc

SEQ ID NO: 181 - DNA, 24 bp, artificial sequence
  LPA RNAi agent antisense strand
  modified_base 2-24: /mod_base = "2'-hydroxy nucleoside"
tucguauaacaauaaggggcugcc

SEQ ID NO: 182 - DNA, 22 bp, artificial sequence
  LPA RNAi agent antisense strand
  modified_base 2-22: /mod_base = "2'-hydroxy nucleoside"
tucguauaacaauaaggggcug

SEQ ID NO: 183 - RNA, 26 nt, artificial sequence
  LPA RNAi agent antisense strand
ugagaaugagccucgauaacuaucgc

SEQ ID NO: 184 - RNA, 26 nt, artificial sequence
  LPA RNAi agent antisense strand
ugagaaugagccucgauaacuauuca

SEQ ID NO: 185 - RNA, 26 nt, artificial sequence
  LPA RNAi agent antisense strand
ugagaaugagccucgauaacuacgau

SEQ ID NO: 186 - RNA, 21 nt, artificial sequence
  LPA RNAi agent antisense strand
ucguauaacaauaaggggcgu

SEQ ID NO: 187 - RNA, 24 nt, artificial sequence
  LPA RNAi agent antisense strand
ucguauaacaauaaggggcugccu

SEQ ID NO: 188 - RNA, 21 nt, artificial sequence
  LPA RNAi agent antisense strand
ucguauaacaauaaggggcug

SEQ ID NO: 189 - DNA, 24 bp, artificial sequence
  LPA RNAi agent antisense strand
  modified_base 2-24: /mod_base = "2'-hydroxy nucleoside"
tcguauaacaauaaggggcugcuu

SEQ ID NO: 190 - DNA, 20 bp, artificial sequence
  LPA RNAi agent sense strand
  modified_base 1-19: /mod_base = "2'-hydroxy nucleoside"
acgcagaagggacugccgat

SEQ ID NO: 191 - DNA, 20 bp, artificial sequence
  LPA RNAi agent sense strand
  modified_base 1-19: /mod_base = "2'-hydroxy nucleoside"
ggggugcaggagugcuacat

SEQ ID NO: 192 - DNA, 20 bp, artificial sequence
  LPA RNAi agent sense strand
  modified_base 1-19: /mod_base = "2'-hydroxy nucleoside"
cuguggcagccccuuauuat

SEQ ID NO: 193 - DNA, 20 bp, artificial sequence
  LPA RNAi agent sense strand
  modified_base 1-19: /mod_base = "2'-hydroxy nucleoside"
ggcagccccuuauuguuaat

SEQ ID NO: 194 - DNA, 20 bp, artificial sequence
  LPA RNAi agent sense strand
  modified_base 1-19: /mod_base = "2'-hydroxy nucleoside"
agccccuuauuguuauacat

SEQ ID NO: 195 - DNA, 20 bp, artificial sequence
  LPA RNAi agent sense strand
  modified_base 1-19: /mod_base = "2'-hydroxy nucleoside"
gccccuuauuguuauacgat

SEQ ID NO: 196 - DNA, 20 bp, artificial sequence
  LPA RNAi agent sense strand
  modified_base 1-19: /mod_base = "2'-hydroxy nucleoside"
ugacacaaugcucagacgat

SEQ ID NO: 197 - DNA, 20 bp, artificial sequence
  LPA RNAi agent sense strand
  modified_base 1-19: /mod_base = "2'-hydroxy nucleoside"
gacacaaugcucagacgcat

SEQ ID NO: 198 - DNA, 20 bp, artificial sequence
  LPA RNAi agent sense strand
  modified_base 1-19: /mod_base = "2'-hydroxy nucleoside"
acacaaugcucagacgcaat

SEQ ID NO: 199 - DNA, 20 bp, artificial sequence
  LPA RNAi agent sense strand
  modified_base 1-19: /mod_base = "2'-hydroxy nucleoside"
acaaugcucagacgcagaat

SEQ ID NO: 200 - DNA, 20 bp, artificial sequence
  LPA RNAi agent sense strand
  modified_base 1-19: /mod_base = "2'-hydroxy nucleoside"
cugccgaaauccagauccat

SEQ ID NO: 201 - DNA, 20 bp, artificial sequence
  LPA RNAi agent sense strand
  modified_base 1-19: /mod_base = "2'-hydroxy nucleoside"
gccgaaauccagauccugat

SEQ ID NO: 202 - DNA, 20 bp, artificial sequence
  LPA RNAi agent sense strand
  modified_base 1-19: /mod_base = "2'-hydroxy nucleoside"
ugacacgaugcucagaugat

SEQ ID NO: 203 - DNA, 20 bp, artificial sequence
  LPA RNAi agent sense strand
  modified_base 1-19: /mod_base = "2'-hydroxy nucleoside"
gacacgaugcucagaugcat

SEQ ID NO: 204 - DNA, 20 bp, artificial sequence
  LPA RNAi agent sense strand
  modified_base 1-19: /mod_base = "2'-hydroxy nucleoside"
acacgaugcucagaugcaat

SEQ ID NO: 205 - DNA, 20 bp, artificial sequence
  LPA RNAi agent sense strand
  modified_base 1-19: /mod_base = "2'-hydroxy nucleoside"
acgaugcucagaugcagaat

SEQ ID NO: 206 - DNA, 20 bp, artificial sequence
  LPA RNAi agent sense strand
  modified_base 1-19: /mod_base = "2'-hydroxy nucleoside"
uccaagccuagaggcuuuat

SEQ ID NO: 207 - DNA, 20 bp, artificial sequence
  LPA RNAi agent sense strand
  modified_base 1-19: /mod_base = "2'-hydroxy nucleoside"
aggaaacccccgggguacat

SEQ ID NO: 208 - DNA, 20 bp, artificial sequence
  LPA RNAi agent sense strand
  modified_base 1-19: /mod_base = "2'-hydroxy nucleoside"
ggaaacccccgggguacaat

SEQ ID NO: 209 - DNA, 20 bp, artificial sequence
  LPA RNAi agent sense strand
  modified_base 1-19: /mod_base = "2'-hydroxy nucleoside"
gaaacccccgggguacagat

SEQ ID NO: 210 - DNA, 20 bp, artificial sequence
  LPA RNAi agent sense strand
  modified_base 1-19: /mod_base = "2'-hydroxy nucleoside"
ugcuacuaccauuauggaat

SEQ ID NO: 211 - DNA, 20 bp, artificial sequence
  LPA RNAi agent sense strand
  modified_base 1-19: /mod_base = "2'-hydroxy nucleoside"
gcuacuaccauuauggacat

SEQ ID NO: 212 - DNA, 20 bp, artificial sequence
  LPA RNAi agent sense strand
  modified_base 1-19: /mod_base = "2'-hydroxy nucleoside"
cuaccauuauggacagagat

SEQ ID NO: 213 - DNA, 20 bp, artificial sequence
  LPA RNAi agent sense strand
  modified_base 1-19: /mod_base = "2'-hydroxy nucleoside"
accacaccagcauagucgat

SEQ ID NO: 214 - DNA, 20 bp, artificial sequence
  LPA RNAi agent sense strand
  modified_base 1-19: /mod_base = "2'-hydroxy nucleoside"
ccacaccagcauagucggat

SEQ ID NO: 215 - DNA, 20 bp, artificial sequence
  LPA RNAi agent sense strand
  modified_base 1-19: /mod_base = "2'-hydroxy nucleoside"
cacaccagcauagucggaat

SEQ ID NO: 216 - DNA, 20 bp, artificial sequence
  LPA RNAi agent sense strand
  modified_base 1-19: /mod_base = "2'-hydroxy nucleoside"
caccagcauagucggaccat

SEQ ID NO: 217 - DNA, 20 bp, artificial sequence
  LPA RNAi agent sense strand
  modified_base 1-19: /mod_base = "2'-hydroxy nucleoside"
auagucggaccccagaaaat

SEQ ID NO: 218 - DNA, 20 bp, artificial sequence
  LPA RNAi agent sense strand
  modified_base 1-19: /mod_base = "2'-hydroxy nucleoside"
uagucggaccccagaaaaat

SEQ ID NO: 219 - DNA, 20 bp, artificial sequence
  LPA RNAi agent sense strand
  modified_base 1-19: /mod_base = "2'-hydroxy nucleoside"
ccagaugcugagauucgcat

SEQ ID NO: 220 - DNA, 20 bp, artificial sequence
  LPA RNAi agent sense strand
  modified_base 1-19: /mod_base = "2'-hydroxy nucleoside"
gcugagauucgcccuuggat

SEQ ID NO: 221 - DNA, 20 bp, artificial sequence
  LPA RNAi agent sense strand
  modified_base 1-19: /mod_base = "2'-hydroxy nucleoside"
cugagauucgcccuugguat

SEQ ID NO: 222 - DNA, 20 bp, artificial sequence
  LPA RNAi agent sense strand
  modified_base 1-19: /mod_base = "2'-hydroxy nucleoside"
ugagauucgcccuuggugat

SEQ ID NO: 223 - DNA, 20 bp, artificial sequence
  LPA RNAi agent sense strand
  modified_base 1-19: /mod_base = "2'-hydroxy nucleoside"
gagauucgcccuugguguat

SEQ ID NO: 224 - DNA, 20 bp, artificial sequence
  LPA RNAi agent sense strand
  modified_base 1-19: /mod_base = "2'-hydroxy nucleoside"
auggaucccagugucaggat

SEQ ID NO: 225 - DNA, 20 bp, artificial sequence
  LPA RNAi agent sense strand
  modified_base 1-19: /mod_base = "2'-hydroxy nucleoside"
gaaucaaguguccuugcaat

SEQ ID NO: 226 - DNA, 20 bp, artificial sequence
  LPA RNAi agent sense strand
  modified_base 1-19: /mod_base = "2'-hydroxy nucleoside"
aaucaaguguccuugcaaat

SEQ ID NO: 227 - DNA, 20 bp, artificial sequence
  LPA RNAi agent sense strand
  modified_base 1-19: /mod_base = "2'-hydroxy nucleoside"
gaagcaccaacggagcaaat

SEQ ID NO: 228 - DNA, 20 bp, artificial sequence
  LPA RNAi agent sense strand
  modified_base 1-19: /mod_base = "2'-hydroxy nucleoside"
gaguuaucgaggcucauuat

SEQ ID NO: 229 - DNA, 20 bp, artificial sequence
  LPA RNAi agent sense strand
  modified_base 1-19: /mod_base = "2'-hydroxy nucleoside"
aguuaucgaggcucauucat

SEQ ID NO: 230 - DNA, 20 bp, artificial sequence
  LPA RNAi agent sense strand
  modified_base 1-19: /mod_base = "2'-hydroxy nucleoside"
gacaacagaauauuauccat

SEQ ID NO: 231 - DNA, 20 bp, artificial sequence
  LPA RNAi agent sense strand
  modified_base 1-19: /mod_base = "2'-hydroxy nucleoside"
cuugguguuauaccauggat

SEQ ID NO: 232 - DNA, 20 bp, artificial sequence
  LPA RNAi agent sense strand
  modified_base 1-19: /mod_base = "2'-hydroxy nucleoside"
gguguuauaccauggaucat

SEQ ID NO: 233 - DNA, 20 bp, artificial sequence
  LPA RNAi agent sense strand
  modified_base 1-19: /mod_base = "2'-hydroxy nucleoside"
uauaccauggaucccaauat

SEQ ID NO: 234 - DNA, 20 bp, artificial sequence
  LPA RNAi agent sense strand
  modified_base 1-19: /mod_base = "2'-hydroxy nucleoside"
auaccauggaucccaaugat

SEQ ID NO: 235 - DNA, 20 bp, artificial sequence
  LPA RNAi agent sense strand
  modified_base 1-19: /mod_base = "2'-hydroxy nucleoside"
uaccauggaucccaauguat

SEQ ID NO: 236 - DNA, 20 bp, artificial sequence
  LPA RNAi agent sense strand
  modified_base 1-19: /mod_base = "2'-hydroxy nucleoside"
accauggaucccaaugucat

SEQ ID NO: 237 - DNA, 20 bp, artificial sequence
  LPA RNAi agent sense strand
  modified_base 1-19: /mod_base = "2'-hydroxy nucleoside"
gcaaccugacacaaugucat

SEQ ID NO: 238 - DNA, 20 bp, artificial sequence
  LPA RNAi agent sense strand
  modified_base 1-19: /mod_base = "2'-hydroxy nucleoside"
cugacacaauguccagugat

SEQ ID NO: 239 - DNA, 20 bp, artificial sequence
  LPA RNAi agent sense strand
  modified_base 1-19: /mod_base = "2'-hydroxy nucleoside"
ccagugacagaaucaaguat

SEQ ID NO: 240 - DNA, 20 bp, artificial sequence
  LPA RNAi agent sense strand
  modified_base 1-19: /mod_base = "2'-hydroxy nucleoside"
uuaucgaggcucauucucat

SEQ ID NO: 241 - DNA, 20 bp, artificial sequence
  LPA RNAi agent sense strand
  modified_base 1-19: /mod_base = "2'-hydroxy nucleoside"
agaauacuacccaaauggat

SEQ ID NO: 242 - DNA, 20 bp, artificial sequence
  LPA RNAi agent sense strand
  modified_base 1-19: /mod_base = "2'-hydroxy nucleoside"
aauacuacccaaauggugat

SEQ ID NO: 243 - DNA, 20 bp, artificial sequence
  LPA RNAi agent sense strand
  modified_base 1-19: /mod_base = "2'-hydroxy nucleoside"
auacuacccaaaugguggat

SEQ ID NO: 244 - DNA, 20 bp, artificial sequence
  LPA RNAi agent sense strand
  modified_base 1-19: /mod_base = "2'-hydroxy nucleoside"
auucgcccuugguguuauat

SEQ ID NO: 245 - DNA, 20 bp, artificial sequence
  LPA RNAi agent sense strand
  modified_base 1-19: /mod_base = "2'-hydroxy nucleoside"
uauaccauggaucccaguat

SEQ ID NO: 246 - DNA, 20 bp, artificial sequence
  LPA RNAi agent sense strand
  modified_base 1-19: /mod_base = "2'-hydroxy nucleoside"
auaccauggaucccagugat

SEQ ID NO: 247 - DNA, 20 bp, artificial sequence
  LPA RNAi agent sense strand
  modified_base 1-19: /mod_base = "2'-hydroxy nucleoside"
cacaacucccacggugguat

SEQ ID NO: 248 - DNA, 20 bp, artificial sequence
  LPA RNAi agent sense strand
  modified_base 1-19: /mod_base = "2'-hydroxy nucleoside"
aagaacaugucagucuugat

SEQ ID NO: 249 - DNA, 20 bp, artificial sequence
  LPA RNAi agent sense strand
  modified_base 1-19: /mod_base = "2'-hydroxy nucleoside"
aguguccucacaacucccat

SEQ ID NO: 250 - DNA, 20 bp, artificial sequence
  LPA RNAi agent sense strand
  modified_base 1-19: /mod_base = "2'-hydroxy nucleoside"
aacaagcaccaccugagaat

SEQ ID NO: 251 - DNA, 20 bp, artificial sequence
  LPA RNAi agent sense strand
  modified_base 1-19: /mod_base = "2'-hydroxy nucleoside"
ccugagaaaagcccugugat

SEQ ID NO: 252 - DNA, 20 bp, artificial sequence
  LPA RNAi agent sense strand
  modified_base 1-19: /mod_base = "2'-hydroxy nucleoside"
ugauaccacacuggcaucat

SEQ ID NO: 253 - DNA, 20 bp, artificial sequence
  LPA RNAi agent sense strand
  modified_base 1-19: /mod_base = "2'-hydroxy nucleoside"
gauaccacacuggcaucaat

SEQ ID NO: 254 - DNA, 20 bp, artificial sequence
  LPA RNAi agent sense strand
  modified_base 1-19: /mod_base = "2'-hydroxy nucleoside"
gaaacagaaucaggugucat

SEQ ID NO: 255 - DNA, 20 bp, artificial sequence
  LPA RNAi agent sense strand
  modified_base 1-19: /mod_base = "2'-hydroxy nucleoside"
aaacagaaucagguguccat

SEQ ID NO: 256 - DNA, 20 bp, artificial sequence
  LPA RNAi agent sense strand
  modified_base 1-19: /mod_base = "2'-hydroxy nucleoside"
cagaaucagguguccuagat

SEQ ID NO: 257 - DNA, 20 bp, artificial sequence
  LPA RNAi agent sense strand
  modified_base 1-19: /mod_base = "2'-hydroxy nucleoside"
ccuguggcagccccuuauat

SEQ ID NO: 258 - DNA, 20 bp, artificial sequence
  LPA RNAi agent sense strand
  modified_base 1-19: /mod_base = "2'-hydroxy nucleoside"
uggcagccccuuauuguuat

SEQ ID NO: 259 - DNA, 20 bp, artificial sequence
  LPA RNAi agent sense strand
  modified_base 1-19: /mod_base = "2'-hydroxy nucleoside"
acaccagcauagucggacat

SEQ ID NO: 260 - DNA, 20 bp, artificial sequence
  LPA RNAi agent sense strand
  modified_base 1-19: /mod_base = "2'-hydroxy nucleoside"
ggaauccagaugcugagaat

SEQ ID NO: 261 - DNA, 20 bp, artificial sequence
  LPA RNAi agent sense strand
  modified_base 1-19: /mod_base = "2'-hydroxy nucleoside"
uccagaugcugagauucgat

SEQ ID NO: 262 - DNA, 20 bp, artificial sequence
  LPA RNAi agent sense strand
  modified_base 1-19: /mod_base = "2'-hydroxy nucleoside"
augcugagauucgcccuuat

SEQ ID NO: 263 - DNA, 20 bp, artificial sequence
  LPA RNAi agent sense strand
  modified_base 1-19: /mod_base = "2'-hydroxy nucleoside"
ccauggaucccagugucaat

SEQ ID NO: 264 - DNA, 20 bp, artificial sequence
  LPA RNAi agent sense strand
  modified_base 1-19: /mod_base = "2'-hydroxy nucleoside"
cugaagaagcaccaacggat

SEQ ID NO: 265 - DNA, 20 bp, artificial sequence
  LPA RNAi agent sense strand
  modified_base 1-19: /mod_base = "2'-hydroxy nucleoside"
uccagugacagaaucaagat

SEQ ID NO: 266 - DNA, 20 bp, artificial sequence
  LPA RNAi agent sense strand
  modified_base 1-19: /mod_base = "2'-hydroxy nucleoside"
cucacaacucccacggugat

SEQ ID NO: 267 - DNA, 20 bp, artificial sequence
  LPA RNAi agent sense strand
  modified_base 1-19: /mod_base = "2'-hydroxy nucleoside"
agaaucagguguccuagaat

SEQ ID NO: 268 - DNA, 20 bp, artificial sequence
  LPA RNAi agent sense strand
  modified_base 1-19: /mod_base = "2'-hydroxy nucleoside"
ucagguguccuagagacuat

SEQ ID NO: 269 - DNA, 23 bp, artificial sequence
  LPA RNAi agent sense strand
  modified_base 1-22: /mod_base = "2'-hydroxy nucleoside"
uauagccccuuauuguuauacat

SEQ ID NO: 270 - DNA, 23 bp, artificial sequence
  LPA RNAi agent sense strand
  modified_base 1-22: /mod_base = "2'-hydroxy nucleoside"
uaugccccuuauuguuauacgat

SEQ ID NO: 271 - DNA, 23 bp, artificial sequence
  LPA RNAi agent sense strand
  modified_base 1-22: /mod_base = "2'-hydroxy nucleoside"
uaugacacaaugcucagacgcat

SEQ ID NO: 272 - DNA, 23 bp, artificial sequence
  LPA RNAi agent sense strand
  modified_base 1-22: /mod_base = "2'-hydroxy nucleoside"
uauacacaaugcucagacgcaat

SEQ ID NO: 273 - DNA, 23 bp, artificial sequence
  LPA RNAi agent sense strand
  modified_base 1-22: /mod_base = "2'-hydroxy nucleoside"
uauuuaucgaggcucauucucat

SEQ ID NO: 274 - DNA, 23 bp, artificial sequence
  LPA RNAi agent sense strand
  modified_base 1-22: /mod_base = "2'-hydroxy nucleoside"
uaugaaacagaaucaggugucat

SEQ ID NO: 275 - DNA, 23 bp, artificial sequence
  LPA RNAi agent sense strand
  modified_base 1-22: /mod_base = "2'-hydroxy nucleoside"
uauacaccagcauagucggacat

SEQ ID NO: 276 - DNA, 23 bp, artificial sequence
  LPA RNAi agent sense strand
  modified_base 1-22: /mod_base = "2'-hydroxy nucleoside"
uauuccagaugcugagauucgat

SEQ ID NO: 277 - DNA, 23 bp, artificial sequence
  LPA RNAi agent sense strand
  modified_base 1-22: /mod_base = "2'-hydroxy nucleoside"
uauaugcugagauucgcccuuat

SEQ ID NO: 278 - DNA, 23 bp, artificial sequence
  LPA RNAi agent sense strand
  modified_base 1-22: /mod_base = "2'-hydroxy nucleoside"
uauccauggaucccagugucaat

SEQ ID NO: 279 - DNA, 20 bp, artificial sequence
  LPA RNAi agent sense strand
  modified_base 1-19: /mod_base = "2'-hydroxy nucleoside"
uguggcagccccuuauugat

SEQ ID NO: 280 - DNA, 20 bp, artificial sequence
  LPA RNAi agent sense strand
  modified_base 1-19: /mod_base = "2'-hydroxy nucleoside"
cacaaugcucagacgcagat

SEQ ID NO: 281 - DNA, 20 bp, artificial sequence
  LPA RNAi agent sense strand
  modified_base 1-19: /mod_base = "2'-hydroxy nucleoside"
ccgaaauccagauccuguat

SEQ ID NO: 282 - DNA, 20 bp, artificial sequence
  LPA RNAi agent sense strand
  modified_base 1-19: /mod_base = "2'-hydroxy nucleoside"
gacugaggaaacccccggat

SEQ ID NO: 283 - DNA, 20 bp, artificial sequence
  LPA RNAi agent sense strand
  modified_base 1-19: /mod_base = "2'-hydroxy nucleoside"
cuacuaccauuauggacaat

SEQ ID NO: 284 - DNA, 20 bp, artificial sequence
  LPA RNAi agent sense strand
  modified_base 1-19: /mod_base = "2'-hydroxy nucleoside"
acuaccauuauggacagaat

SEQ ID NO: 285 - DNA, 20 bp, artificial sequence
  LPA RNAi agent sense strand
  modified_base 1-19: /mod_base = "2'-hydroxy nucleoside"
uaccauuauggacagaguat

SEQ ID NO: 286 - DNA, 20 bp, artificial sequence
  LPA RNAi agent sense strand
  modified_base 1-19: /mod_base = "2'-hydroxy nucleoside"
accauuauggacagaguuat

SEQ ID NO: 287 - DNA, 20 bp, artificial sequence
  LPA RNAi agent sense strand
  modified_base 1-19: /mod_base = "2'-hydroxy nucleoside"
agaugcugagauucgcccat

SEQ ID NO: 288 - DNA, 20 bp, artificial sequence
  LPA RNAi agent sense strand
  modified_base 1-19: /mod_base = "2'-hydroxy nucleoside"
gaugcugagauucgcccuat

SEQ ID NO: 289 - DNA, 20 bp, artificial sequence
  LPA RNAi agent sense strand
  modified_base 1-19: /mod_base = "2'-hydroxy nucleoside"
agauucgcccuugguguuat

SEQ ID NO: 290 - DNA, 20 bp, artificial sequence
  LPA RNAi agent sense strand
  modified_base 1-19: /mod_base = "2'-hydroxy nucleoside"
gacagaaucaaguguccuat

SEQ ID NO: 291 - DNA, 20 bp, artificial sequence
  LPA RNAi agent sense strand
  modified_base 1-19: /mod_base = "2'-hydroxy nucleoside"
acaugucagucuugguccat

SEQ ID NO: 292 - DNA, 20 bp, artificial sequence
  LPA RNAi agent sense strand
  modified_base 1-19: /mod_base = "2'-hydroxy nucleoside"
ccaaaugguggccugaccat

SEQ ID NO: 293 - DNA, 20 bp, artificial sequence
  LPA RNAi agent sense strand
  modified_base 1-19: /mod_base = "2'-hydroxy nucleoside"
ugguguuauaccauggauat

SEQ ID NO: 294 - DNA, 20 bp, artificial sequence
  LPA RNAi agent sense strand
  modified_base 1-19: /mod_base = "2'-hydroxy nucleoside"
uguuauaccauggaucccat

SEQ ID NO: 295 - DNA, 20 bp, artificial sequence
  LPA RNAi agent sense strand
  modified_base 1-19: /mod_base = "2'-hydroxy nucleoside"
aaccugacacaauguccaat

SEQ ID NO: 296 - DNA, 20 bp, artificial sequence
  LPA RNAi agent sense strand
  modified_base 1-19: /mod_base = "2'-hydroxy nucleoside"
aauguccagugacagaauat

SEQ ID NO: 297 - DNA, 20 bp, artificial sequence
  LPA RNAi agent sense strand
  modified_base 1-19: /mod_base = "2'-hydroxy nucleoside"
uguuucugaacaagcaccat

SEQ ID NO: 298 - DNA, 20 bp, artificial sequence
  LPA RNAi agent sense strand
  modified_base 1-19: /mod_base = "2'-hydroxy nucleoside"
uaucgaggcucauucuccat

SEQ ID NO: 299 - DNA, 20 bp, artificial sequence
  LPA RNAi agent sense strand
  modified_base 1-19: /mod_base = "2'-hydroxy nucleoside"
ucgaggcucauucuccacat

SEQ ID NO: 300 - DNA, 20 bp, artificial sequence
  LPA RNAi agent sense strand
  modified_base 1-19: /mod_base = "2'-hydroxy nucleoside"
uccucacaacucccacggat

SEQ ID NO: 301 - DNA, 20 bp, artificial sequence
  LPA RNAi agent sense strand
  modified_base 1-19: /mod_base = "2'-hydroxy nucleoside"
caacucccacggugguccat

SEQ ID NO: 302 - DNA, 20 bp, artificial sequence
  LPA RNAi agent sense strand
  modified_base 1-19: /mod_base = "2'-hydroxy nucleoside"
gcuccuucugaacaagcaat

SEQ ID NO: 303 - DNA, 20 bp, artificial sequence
  LPA RNAi agent sense strand
  modified_base 1-19: /mod_base = "2'-hydroxy nucleoside"
auaccacacuggcaucagat

SEQ ID NO: 304 - DNA, 20 bp, artificial sequence
  LPA RNAi agent sense strand
  modified_base 1-19: /mod_base = "2'-hydroxy nucleoside"
acagaaucagguguccuaat

SEQ ID NO: 305 - DNA, 20 bp, artificial sequence
  LPA RNAi agent sense strand
  modified_base 1-19: /mod_base = "2'-hydroxy nucleoside"
gaaucagguguccuagagat

SEQ ID NO: 306 - DNA, 20 bp, artificial sequence
  LPA RNAi agent sense strand
  modified_base 1-19: /mod_base = "2'-hydroxy nucleoside"
aaucagguguccuagagaat

SEQ ID NO: 307 - DNA, 20 bp, artificial sequence
  LPA RNAi agent sense strand
  modified_base 1-19: /mod_base = "2'-hydroxy nucleoside"
aucagguguccuagagacat

SEQ ID NO: 308 - RNA, 26 nt, artificial sequence
  LPA RNAi agent sense strand
uauauaguuaucgaggcucauucuca

SEQ ID NO: 309 - RNA, 26 nt, artificial sequence
  LPA RNAi agent sense strand
uauaucagaaacagaaucagguguca

SEQ ID NO: 310 - RNA, 26 nt, artificial sequence
  LPA RNAi agent sense strand
uauaucagccccuuauuguuauacga

SEQ ID NO: 311 - RNA, 26 nt, artificial sequence
  LPA RNAi agent sense strand
uauaucugacacaaugcucagacgca

SEQ ID NO: 312 - RNA, 26 nt, artificial sequence
  LPA RNAi agent sense strand
uauauugacacaaugcucagacgcaa

SEQ ID NO: 313 - RNA, 26 nt, artificial sequence
  LPA RNAi agent sense strand
uauauagaugcugagauucgcccuua

SEQ ID NO: 314 - RNA, 18 nt, artificial sequence
  LPA RNAi agent sense strand
gcagccccuuauuguuaa

SEQ ID NO: 315 - RNA, 18 nt, artificial sequence
  LPA RNAi agent sense strand
gccccuuauuguuauaca

SEQ ID NO: 316 - RNA, 18 nt, artificial sequence
  LPA RNAi agent sense strand
ccccuuauuguuauacga

SEQ ID NO: 317 - RNA, 18 nt, artificial sequence
  LPA RNAi agent sense strand
acacaaugcucagacgca

SEQ ID NO: 318 - RNA, 18 nt, artificial sequence
  LPA RNAi agent sense strand
cacaaugcucagacgcaa

SEQ ID NO: 319 - RNA, 18 nt, artificial sequence
  LPA RNAi agent sense strand
ccgaaauccagauccuga

SEQ ID NO: 320 - RNA, 18 nt, artificial sequence
  LPA RNAi agent sense strand
cacgaugcucagaugcaa

SEQ ID NO: 321 - RNA, 18 nt, artificial sequence
  LPA RNAi agent sense strand
ccacaccagcauagucga

SEQ ID NO: 322 - RNA, 18 nt, artificial sequence
  LPA RNAi agent sense strand
uagucggaccccagaaaa

SEQ ID NO: 323 - RNA, 18 nt, artificial sequence
  LPA RNAi agent sense strand
cagaugcugagauucgca

SEQ ID NO: 324 - RNA, 18 nt, artificial sequence
  LPA RNAi agent sense strand
aaucaaguguccuugcaa

SEQ ID NO: 325 - RNA, 18 nt, artificial sequence
  LPA RNAi agent sense strand
aguuaucgaggcucauua

SEQ ID NO: 326 - RNA, 18 nt, artificial sequence
  LPA RNAi agent sense strand
guuaucgaggcucauuca

SEQ ID NO: 327 - RNA, 18 nt, artificial sequence
  LPA RNAi agent sense strand
caaccugacacaauguca

SEQ ID NO: 328 - RNA, 18 nt, artificial sequence
  LPA RNAi agent sense strand
uaucgaggcucauucuca

SEQ ID NO: 329 - RNA, 18 nt, artificial sequence
  LPA RNAi agent sense strand
gaauacuacccaaaugga

SEQ ID NO: 330 - RNA, 18 nt, artificial sequence
  LPA RNAi agent sense strand
auacuacccaaaugguga

SEQ ID NO: 331 - RNA, 18 nt, artificial sequence
  LPA RNAi agent sense strand
aaacagaaucagguguca

SEQ ID NO: 332 - RNA, 18 nt, artificial sequence
  LPA RNAi agent sense strand
aacagaaucaggugucca

SEQ ID NO: 333 - RNA, 17 nt, artificial sequence
  LPA RNAi agent sense strand
cagccccuuauuguuaa

SEQ ID NO: 334 - RNA, 17 nt, artificial sequence
  LPA RNAi agent sense strand
ccccuuauuguuauaca

SEQ ID NO: 335 - RNA, 17 nt, artificial sequence
  LPA RNAi agent sense strand
cccuuauuguuauacga

SEQ ID NO: 336 - RNA, 17 nt, artificial sequence
  LPA RNAi agent sense strand
cacaaugcucagacgca

SEQ ID NO: 337 - RNA, 17 nt, artificial sequence
  LPA RNAi agent sense strand
acaaugcucagacgcaa

SEQ ID NO: 338 - RNA, 17 nt, artificial sequence
  LPA RNAi agent sense strand
cgaaauccagauccuga

SEQ ID NO: 339 - RNA, 17 nt, artificial sequence
  LPA RNAi agent sense strand
acgaugcucagaugcaa

SEQ ID NO: 340 - RNA, 17 nt, artificial sequence
  LPA RNAi agent sense strand
cacaccagcauagucga

SEQ ID NO: 341 - RNA, 17 nt, artificial sequence
  LPA RNAi agent sense strand
agucggaccccagaaaa

SEQ ID NO: 342 - RNA, 17 nt, artificial sequence
  LPA RNAi agent sense strand
agaugcugagauucgca

SEQ ID NO: 343 - RNA, 17 nt, artificial sequence
  LPA RNAi agent sense strand
aucaaguguccuugcaa

SEQ ID NO: 344 - RNA, 17 nt, artificial sequence
  LPA RNAi agent sense strand
guuaucgaggcucauua

SEQ ID NO: 345 - RNA, 17 nt, artificial sequence
  LPA RNAi agent sense strand
uuaucgaggcucauuca

SEQ ID NO: 346 - RNA, 17 nt, artificial sequence
  LPA RNAi agent sense strand
aaccugacacaauguca

SEQ ID NO: 347 - RNA, 17 nt, artificial sequence
  LPA RNAi agent sense strand
aucgaggcucauucuca

SEQ ID NO: 348 - RNA, 17 nt, artificial sequence
  LPA RNAi agent sense strand
aauacuacccaaaugga

SEQ ID NO: 349 - RNA, 17 nt, artificial sequence
  LPA RNAi agent sense strand
uacuacccaaaugguga

SEQ ID NO: 350 - RNA, 17 nt, artificial sequence
  LPA RNAi agent sense strand
aacagaaucagguguca

SEQ ID NO: 351 - RNA, 17 nt, artificial sequence
  LPA RNAi agent sense strand
acagaaucaggugucca

SEQ ID NO: 352 - RNA, 26 nt, artificial sequence
  LPA RNAi agent sense strand
uauaucagcgccuuauuguuauacga

SEQ ID NO: 353 - DNA, 17 bp, artificial sequence
  LPA RNAi agent sense strand
  modified_base 1,3-17: /mod_base = "2'-hydroxy nucleoside"
atcgaggcucauucuca

SEQ ID NO: 354 - RNA, 24 nt, artificial sequence
  LPA RNAi agent sense strand
ucagccccuuauuguuauacgauu

SEQ ID NO: 355 - RNA, 22 nt, artificial sequence
  LPA RNAi agent sense strand
ucagccccuuauuguuauacga

SEQ ID NO: 356 - RNA, 24 nt, artificial sequence
  LPA RNAi agent sense strand
uaguuaucgaggcucauucucauu

SEQ ID NO: 357 - RNA, 21 nt, artificial sequence
  LPA RNAi agent sense strand
gccccuuauuguuauacgauu

SEQ ID NO: 358 - DNA, 26 bp, artificial sequence
  LPA RNAi agent sense strand
  modified_base 1-25: /mod_base = "2'-hydroxy nucleoside"
auaucagccccuuauuguuauacgat

SEQ ID NO: 359 - DNA, 26 bp, artificial sequence
  LPA RNAi agent sense strand
  modified_base 1-25: /mod_base = "2'-hydroxy nucleoside"
uaucagccccuuauuguuauacgaut

SEQ ID NO: 360 - DNA, 26 bp, artificial sequence
  LPA RNAi agent sense strand
  modified_base 1-25: /mod_base = "2'-hydroxy nucleoside"
auauaguuaucgaggcucauucucat

SEQ ID NO: 361 - DNA, 26 bp, artificial sequence
  LPA RNAi agent sense strand
  modified_base 1-25: /mod_base = "2'-hydroxy nucleoside"
uauaguuaucgaggcucauucucaut

SEQ ID NO: 362 - RNA, 21 nt, artificial sequence
  LPA RNAi agent sense strand
uuaucgaggcucauucucauu

SEQ ID NO: 363 - RNA, 26 nt, artificial sequence
  LPA RNAi agent sense strand
uauauaauuaucgaggcucauucuca

SEQ ID NO: 364 - DNA, 25 bp, artificial sequence
  LPA RNAi agent sense strand
  modified_base 1-23: /mod_base = "2'-hydroxy nucleoside"
ggcagccccuuauuguuauacgatt

SEQ ID NO: 365 - DNA, 26 bp, artificial sequence
  LPA RNAi agent sense strand
  modified_base 1-25: /mod_base = "2'-hydroxy nucleoside"
ggcagccccuuauuguuauacgauut

SEQ ID NO: 366 - DNA, 25 bp, artificial sequence
  LPA RNAi agent sense strand
  modified_base 1-21: /mod_base = "2'-hydroxy nucleoside"
cagccccuuauuguuauacgatttt

SEQ ID NO: 367 - RNA, 26 nt, artificial sequence
  LPA RNAi agent sense strand
gcgauaguuaucgaggcucauucuca

SEQ ID NO: 368 - RNA, 26 nt, artificial sequence
  LPA RNAi agent sense strand
ugaauaguuaucgaggcucauucuca

SEQ ID NO: 369 - RNA, 26 nt, artificial sequence
  LPA RNAi agent sense strand
aucguaguuaucgaggcucauucuca

SEQ ID NO: 370 - RNA, 26 nt, artificial sequence
  LPA RNAi agent sense strand
uauaaaguuaucgaggcucauucuca

SEQ ID NO: 371 - RNA, 20 nt, artificial sequence
  LPA RNAi agent sense strand
agccccuuauuguuauacga

SEQ ID NO: 372 - RNA, 21 nt, artificial sequence
  LPA RNAi agent sense strand
aagccccuuauuguuauacga

SEQ ID NO: 373 - RNA, 22 nt, artificial sequence
  LPA RNAi agent sense strand
gcagccccuuauuguuauacga

SEQ ID NO: 374 - RNA, 26 nt, artificial sequence
  LPA RNAi agent sense strand
uauauaguuaucgaggcucauucuca

SEQ ID NO: 375 - RNA, 21 nt, artificial sequence
  LPA RNAi agent sense strand
acgccccuuauuguuauacga

SEQ ID NO: 376 - RNA, 21 nt, artificial sequence
  LPA RNAi agent sense strand
gccccuuauuguuauacgauu

SEQ ID NO: 377 - RNA, 22 nt, artificial sequence
  LPA RNAi agent sense strand
agccccuuauuguuauacgauu

SEQ ID NO: 378 - RNA, 23 nt, artificial sequence
  LPA RNAi agent sense strand
aagccccuuauuguuauacgauu

SEQ ID NO: 379 - RNA, 24 nt, artificial sequence
  LPA RNAi agent sense strand
uaucagccccuuauuguuauacga

SEQ ID NO: 380 - RNA, 24 nt, artificial sequence
  LPA RNAi agent sense strand
uagcagccccuuauuguuauacga

SEQ ID NO: 381 - RNA, 22 nt, artificial sequence
  LPA RNAi agent sense strand
gcagccccuuauuguuauacga

SEQ ID NO: 382 - RNA, 26 nt, artificial sequence
  LPA RNAi agent sense strand
auaagaguuaucgaggcucauucuca

SEQ ID NO: 383 - RNA, 26 nt, artificial sequence
  LPA RNAi agent sense strand
auaggcagccccuuauuguuauacga

SEQ ID NO: 384 - RNA, 21 nt, artificial sequence
  LPA RNAi agent sense strand
cagccccuuauuguuauacga

SEQ ID NO: 385 - DNA, 26 bp, artificial sequence
  LPA RNAi agent sense strand
  modified_base 1,2,3,4,5,6,7,8,9,10,11,12,14,15,16,17,18,19,20,21,22,23,24,25,26: /mod_base = "2'-hydroxy nucleoside"
uauaucagcccctuauuguuauacga

SEQ ID NO: 386 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcggcagucccuucugcgutt

SEQ ID NO: 387 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tguagcacuccugcacccctt

SEQ ID NO: 388 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taauaaggggcugccacagtt

SEQ ID NO: 389 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuaacaauaaggggcugcctt

SEQ ID NO: 390 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tguauaacaauaaggggcutt

SEQ ID NO: 391 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcguauaacaauaaggggctt

SEQ ID NO: 392 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcgucugagcauugugucatt

SEQ ID NO: 393 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgcgucugagcauuguguctt

SEQ ID NO: 394 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tugcgucugagcauugugutt

SEQ ID NO: 395 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tucugcgucugagcauugutt

SEQ ID NO: 396 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tggaucuggauuucggcagtt

SEQ ID NO: 397 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaggaucuggauuucggctt

SEQ ID NO: 398 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaucugagcaucgugucatt

SEQ ID NO: 399 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgcaucugagcaucguguctt

SEQ ID NO: 400 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tugcaucugagcaucgugutt

SEQ ID NO: 401 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tucugcaucugagcaucgutt

SEQ ID NO: 402 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taaagccucuaggcuuggatt

SEQ ID NO: 403 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tguaccccggggguuuccutt

SEQ ID NO: 404 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuguaccccggggguuucctt

SEQ ID NO: 405 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcuguaccccggggguuuctt

SEQ ID NO: 406 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuccauaaugguaguagcatt

SEQ ID NO: 407 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tguccauaaugguaguagctt

SEQ ID NO: 408 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcucuguccauaaugguagtt

SEQ ID NO: 409 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcgacuaugcugguguggutt

SEQ ID NO: 410 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccgacuaugcugguguggtt

SEQ ID NO: 411 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuccgacuaugcuggugugtt

SEQ ID NO: 412 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgguccgacuaugcuggugtt

SEQ ID NO: 413 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuuucugggguccgacuautt

SEQ ID NO: 414 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuuuucugggguccgacuatt

SEQ ID NO: 415 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgcgaaucucagcaucuggtt

SEQ ID NO: 416 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccaagggcgaaucucagctt

SEQ ID NO: 417 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taccaagggcgaaucucagtt

SEQ ID NO: 418 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaccaagggcgaaucucatt

SEQ ID NO: 419 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tacaccaagggcgaaucuctt

SEQ ID NO: 420 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccugacacugggauccautt

SEQ ID NO: 421 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tugcaaggacacuugauuctt

SEQ ID NO: 422 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuugcaaggacacuugauutt

SEQ ID NO: 423 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tuugcuccguuggugcuuctt

SEQ ID NO: 424 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taaugagccucgauaacuctt

SEQ ID NO: 425 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgaaugagccucgauaacutt

SEQ ID NO: 426 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tggauaauauucuguuguctt

SEQ ID NO: 427 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccaugguauaacaccaagtt

SEQ ID NO: 428 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgauccaugguauaacacctt

SEQ ID NO: 429 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tauugggauccaugguauatt

SEQ ID NO: 430 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcauugggauccaugguautt

SEQ ID NO: 431 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tacauugggauccaugguatt

SEQ ID NO: 432 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgacauugggauccauggutt

SEQ ID NO: 433 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgacauugugucagguugctt

SEQ ID NO: 434 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcacuggacauugugucagtt

SEQ ID NO: 435 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tacuugauucugucacuggtt

SEQ ID NO: 436 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgagaaugagccucgauaatt

SEQ ID NO: 437 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccauuuggguaguauucutt

SEQ ID NO: 438 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaccauuuggguaguauutt

SEQ ID NO: 439 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccaccauuuggguaguautt

SEQ ID NO: 440 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tauaacaccaagggcgaautt

SEQ ID NO: 441 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tacugggauccaugguauatt

SEQ ID NO: 442 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcacugggauccaugguautt

SEQ ID NO: 443 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taccaccgugggaguugugtt

SEQ ID NO: 444 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaagacugacauguucuutt

SEQ ID NO: 445 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgggaguugugaggacacutt

SEQ ID NO: 446 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tucucagguggugcuuguutt

SEQ ID NO: 447 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcacagggcuuuucucaggtt

SEQ ID NO: 448 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgaugccagugugguaucatt

SEQ ID NO: 449 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tugaugccagugugguauctt

SEQ ID NO: 450 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tgacaccugauucuguuuctt

SEQ ID NO: 451 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tggacaccugauucuguuutt

SEQ ID NO: 452 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcuaggacaccugauucugtt

SEQ ID NO: 453 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tauaaggggcugccacaggtt

SEQ ID NO: 454 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taacaauaaggggcugccatt

SEQ ID NO: 455 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tguccgacuaugcuggugutt

SEQ ID NO: 456 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tucucagcaucuggauucctt

SEQ ID NO: 457 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcgaaucucagcaucuggatt

SEQ ID NO: 458 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
taagggcgaaucucagcautt

SEQ ID NO: 459 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tugacacugggauccauggtt

SEQ ID NO: 460 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tccguuggugcuucuucagtt

SEQ ID NO: 461 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcuugauucugucacuggatt

SEQ ID NO: 462 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tcaccgugggaguugugagtt

SEQ ID NO: 463 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tucuaggacaccugauucutt

SEQ ID NO: 464 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 3,5,7,9,11,13,15,17,19: /mod_base = "2'-O-methyl nucleoside"
  modified_base 21: /mod_base = "phosphorothioate linked nucleoside"
tagucucuaggacaccugatt

SEQ ID NO: 465 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tguauaacaauaaggggcutt

SEQ ID NO: 466 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tguauaacaauaaggggcutt

SEQ ID NO: 467 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tguauaacaauaaggggcutt

SEQ ID NO: 468 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcguauaacaauaaggggctt

SEQ ID NO: 469 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcguauaacaauaaggggctt

SEQ ID NO: 470 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tcguauaacaauaaggggctt

SEQ ID NO: 471 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgcgucugagcauuguguctt

SEQ ID NO: 472 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgcgucugagcauuguguctt

SEQ ID NO: 473 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tgcgucugagcauuguguctt

SEQ ID NO: 474 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tugcgucugagcauugugutt

SEQ ID NO: 475 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tugcgucugagcauugugutt

SEQ ID NO: 476 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tugcgucugagcauugugutt

SEQ ID NO: 477 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgagaaugagccucgauaatt

SEQ ID NO: 478 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgagaaugagccucgauaatt

SEQ ID NO: 479 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tgagaaugagccucgauaatt

SEQ ID NO: 480 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgacaccugauucuguuuctt

SEQ ID NO: 481 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgacaccugauucuguuuctt

SEQ ID NO: 482 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tgacaccugauucuguuuctt

SEQ ID NO: 483 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tguccgacuaugcuggugutt

SEQ ID NO: 484 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tguccgacuaugcuggugutt

SEQ ID NO: 485 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tguccgacuaugcuggugutt

SEQ ID NO: 486 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcgaaucucagcaucuggatt

SEQ ID NO: 487 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcgaaucucagcaucuggatt

SEQ ID NO: 488 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tcgaaucucagcaucuggatt

SEQ ID NO: 489 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
taagggcgaaucucagcautt

SEQ ID NO: 490 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
taagggcgaaucucagcautt

SEQ ID NO: 491 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
taagggcgaaucucagcautt

SEQ ID NO: 492 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tugacacugggauccauggtt

SEQ ID NO: 493 - DNA, 21 bp, artificial sequence
  LPA RNAi agent antisense strand
  modified_base 6: /mod_base = "2'-3' seco nucleoside"
  modified_base 2,4,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tugacacugggauccauggtt

SEQ ID NO: 494 - DNA, 21 bp, artificial sequence
  LPA RNAi agent antisense strand
  modified_base 7: /mod_base = "2'-3' seco nucleoside"
  modified_base 2,4,6,8,10,14,16,18: /mod_base = "2'-deoxy-2'-fluoro nucleoside"
  modified_base 3,5,9,11,12,13,15,17,19: /mod_base = "2'-O-methyl nucleoside"
  modified_base 21: /mod_base = "phosphorothioate linked nucleoside"
tugacacugggauccauggtt

SEQ ID NO: 495 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcaauaaggggcugccacatt

SEQ ID NO: 496 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcugcgucugagcauugugtt

SEQ ID NO: 497 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tacaggaucuggauuucggtt

SEQ ID NO: 498 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tccggggguuuccucaguctt

SEQ ID NO: 499 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tuguccauaaugguaguagtt

SEQ ID NO: 500 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tucuguccauaaugguagutt

SEQ ID NO: 501 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tacucuguccauaaugguatt

SEQ ID NO: 502 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
taacucuguccauaauggutt

SEQ ID NO: 503 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgggcgaaucucagcaucutt

SEQ ID NO: 504 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tagggcgaaucucagcauctt

SEQ ID NO: 505 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
taacaccaagggcgaaucutt

SEQ ID NO: 506 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
taggacacuugauucuguctt

SEQ ID NO: 507 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tggaccaagacugacaugutt

SEQ ID NO: 508 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tggucaggccaccauuuggtt

SEQ ID NO: 509 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tauccaugguauaacaccatt

SEQ ID NO: 510 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgggauccaugguauaacatt

SEQ ID NO: 511 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tuggacauugugucagguutt

SEQ ID NO: 512 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tauucugucacuggacauutt

SEQ ID NO: 513 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tggugcuuguucagaaacatt

SEQ ID NO: 514 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tggagaaugagccucgauatt

SEQ ID NO: 515 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tguggagaaugagccucgatt

SEQ ID NO: 516 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tccgugggaguugugaggatt

SEQ ID NO: 517 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tggaccaccgugggaguugtt

SEQ ID NO: 518 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tugcuuguucagaaggagctt

SEQ ID NO: 519 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcugaugccagugugguautt

SEQ ID NO: 520 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tuaggacaccugauucugutt

SEQ ID NO: 521 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tcucuaggacaccugauuctt

SEQ ID NO: 522 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tucucuaggacaccugauutt

SEQ ID NO: 523 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 3,5,7,9,11,12,13,15,17,19: /mod_base = "2'-O-methyl nucleoside"
  modified_base 21: /mod_base = "phosphorothioate linked nucleoside"
tgucucuaggacaccugautt

SEQ ID NO: 524 - DNA, 26 bp, artificial sequence
  LPA RNAi agent antisense strand
  modified_base 2,4,6,8,10,12,14,16,18,20,22: /mod_base = "2'-deoxy-2'-fluoro nucleoside"
  modified_base 3,5,7,9,11,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 525 - DNA, 26 bp, artificial sequence
  LPA RNAi agent antisense strand
  modified_base 2,4,6,8,10,13,14,16,18,20,22: /mod_base = "2'-deoxy-2'-fluoro nucleoside"
  modified_base 3,5,7,9,11,12,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 526 - DNA, 26 bp, artificial sequence
  LPA RNAi agent antisense strand
  modified_base 2,4,6,8,10,13,16,18,20,22: /mod_base = "2'-deoxy-2'-fluoro nucleoside"
  modified_base 3,5,7,9,11,12,14,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 527 - DNA, 26 bp, artificial sequence
  LPA RNAi agent antisense strand
  modified_base 2,4,6,8,10,12,13,15,17,19,21,23: /mod_base = "2'-deoxy-2'-fluoro nucleoside"
  modified_base 3,5,7,9,11,14,16,18,20,22,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 528 - DNA, 26 bp, artificial sequence
  LPA RNAi agent antisense strand
  modified_base 2,4,6,8,10,12,14,16,18,20,22: /mod_base = "2'-deoxy-2'-fluoro nucleoside"
  modified_base 3,5,7,9,11,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 529 - DNA, 26 bp, artificial sequence
  LPA RNAi agent antisense strand
  modified_base 2,4,6,8,10,13,14,16,18,20,22: /mod_base = "2'-deoxy-2'-fluoro nucleoside"
  modified_base 3,5,7,9,11,12,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 530 - DNA, 26 bp, artificial sequence
  LPA RNAi agent antisense strand
  modified_base 2,4,6,8,10,13,16,18,20,22: /mod_base = "2'-deoxy-2'-fluoro nucleoside"
  modified_base 3,5,7,9,11,12,14,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 531 - DNA, 26 bp, artificial sequence
  LPA RNAi agent antisense strand
  modified_base 2,4,6,8,10,12,13,15,17,19,21,23: /mod_base = "2'-deoxy-2'-fluoro nucleoside"
  modified_base 3,5,7,9,11,14,16,18,20,22,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 532 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tcguauaacaauaaggggcugccuau

SEQ ID NO: 533 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgcgucugagcauugugucagguuau

SEQ ID NO: 534 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tugcgucugagcauugugucagguau

SEQ ID NO: 535 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 536 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 537 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
taagggcgaaucucagcaucugguau

SEQ ID NO: 538 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uuaacaauaaggggcugc

SEQ ID NO: 539 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uguauaacaauaaggggc

SEQ ID NO: 540 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucguauaacaauaagggg

SEQ ID NO: 541 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugcgucugagcauugugu

SEQ ID NO: 542 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcgucugagcauugug

SEQ ID NO: 543 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucaggaucuggauuucgg

SEQ ID NO: 544 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcaucugagcaucgug

SEQ ID NO: 545 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucgacuaugcuggugugg

SEQ ID NO: 546 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uuuucugggguccgacua

SEQ ID NO: 547 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugcgaaucucagcaucug

SEQ ID NO: 548 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcaaggacacuugauu

SEQ ID NO: 549 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uaaugagccucgauaacu

SEQ ID NO: 550 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugaaugagccucgauaac

SEQ ID NO: 551 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugacauugugucagguug

SEQ ID NO: 552 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugagaaugagccucgaua

SEQ ID NO: 553 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uccauuuggguaguauuc

SEQ ID NO: 554 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucaccauuuggguaguau

SEQ ID NO: 555 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugacaccugauucuguuu

SEQ ID NO: 556 - DNA, 18 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uggacaccugauucuguu

SEQ ID NO: 557 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uuaacaauaaggggcug

SEQ ID NO: 558 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uguauaacaauaagggg

SEQ ID NO: 559 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucguauaacaauaaggg

SEQ ID NO: 560 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugcgucugagcauugug

SEQ ID NO: 561 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcgucugagcauugu

SEQ ID NO: 562 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucaggaucuggauuucg

SEQ ID NO: 563 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcaucugagcaucgu

SEQ ID NO: 564 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucgacuaugcuggugug

SEQ ID NO: 565 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uuuucugggguccgacu

SEQ ID NO: 566 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugcgaaucucagcaucu

SEQ ID NO: 567 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uugcaaggacacuugau

SEQ ID NO: 568 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uaaugagccucgauaac

SEQ ID NO: 569 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugaaugagccucgauaa

SEQ ID NO: 570 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugacauugugucagguu

SEQ ID NO: 571 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugagaaugagccucgau

SEQ ID NO: 572 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uccauuuggguaguauu

SEQ ID NO: 573 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ucaccauuuggguagua

SEQ ID NO: 574 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
ugacaccugauucuguu

SEQ ID NO: 575 - DNA, 17 bp, artificial sequence
  LPA RNAi agent antisense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 2,3: /mod_base = "phosphorothioate linked nucleoside"
uggacaccugauucugu

SEQ ID NO: 576 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 1,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 577 - DNA, 26 bp, artificial sequence
  LPA RNAi agent antisense strand
  modified_base 4,6,8,10,14,16,18,20,22: /mod_base = "2'-deoxy-2'-fluoro nucleoside"
  modified_base 1,2,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 578 - DNA, 26 bp, artificial sequence
  LPA RNAi agent antisense strand
  modified_base 4,6,8,10,14,16,18,20: /mod_base = "2'-deoxy-2'-fluoro nucleoside"
  modified_base 1,2,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 579 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 580 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 1,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 581 - DNA, 26 bp, artificial sequence
  LPA RNAi agent antisense strand
  modified_base 4,6,8,10,14,16,18,20,22: /mod_base = "2'-deoxy-2'-fluoro nucleoside"
  modified_base 1,2,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 582 - DNA, 26 bp, artificial sequence
  LPA RNAi agent antisense strand
  modified_base 4,6,8,10,14,16,18,20: /mod_base = "2'-deoxy-2'-fluoro nucleoside"
  modified_base 1,2,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 583 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 584 - DNA, 26 bp, artificial sequence
  LPA RNAi agent antisense strand
  modified_base 6,10,14,16,20,22: /mod_base = "2'-deoxy-2'-fluoro nucleoside"
  modified_base 1,2,3,4,5,7,8,9,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 585 - DNA, 26 bp, artificial sequence
  LPA RNAi agent antisense strand
  modified_base 8,14,18,20,22: /mod_base = "2'-deoxy-2'-fluoro nucleoside"
  modified_base 1,2,3,4,5,6,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 586 - DNA, 26 bp, artificial sequence
  LPA RNAi agent antisense strand
  modified_base 8,14,18: /mod_base = "2'-deoxy-2'-fluoro nucleoside"
  modified_base 1,2,3,4,5,6,7,9,10,11,12,13,15,16,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 587 - DNA, 26 bp, artificial sequence
  LPA RNAi agent antisense strand
  modified_base 4,6,8,10,14,16,20: /mod_base = "2'-deoxy-2'-fluoro nucleoside"
  modified_base 1,2,3,5,7,9,11,12,13,15,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 588 - DNA, 26 bp, artificial sequence
  LPA RNAi agent antisense strand
  modified_base 4,6,8,10,14,18: /mod_base = "2'-deoxy-2'-fluoro nucleoside"
  modified_base 1,2,3,5,7,9,11,12,13,15,16,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 589 - DNA, 26 bp, artificial sequence
  LPA RNAi agent antisense strand
  modified_base 10,14,16,20: /mod_base = "2'-deoxy-2'-fluoro nucleoside"
  modified_base 1,2,3,4,5,6,7,8,9,11,12,13,15,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 590 - DNA, 26 bp, artificial sequence
  LPA RNAi agent antisense strand
  modified_base 2,3,5,7,8,10,14,16,18,20,22: /mod_base = "2'-deoxy-2'-fluoro nucleoside"
  modified_base 1,4,6,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 591 - DNA, 26 bp, artificial sequence
  LPA RNAi agent antisense strand
  modified_base 2,3,5,8,10,14,16,18,20,22: /mod_base = "2'-deoxy-2'-fluoro nucleoside"
  modified_base 1,4,6,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 592 - DNA, 26 bp, artificial sequence
  LPA RNAi agent antisense strand
  modified_base 2,4,6,7,8,10,14,16,18,20,22: /mod_base = "2'-deoxy-2'-fluoro nucleoside"
  modified_base 1,3,5,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 593 - DNA, 26 bp, artificial sequence
  LPA RNAi agent antisense strand
  modified_base 2,4,6,14,16,18,20,22: /mod_base = "2'-deoxy-2'-fluoro nucleoside"
  modified_base 3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 594 - DNA, 26 bp, artificial sequence
  LPA RNAi agent antisense strand
  modified_base 2,4,6,14,16,18,20,22: /mod_base = "2'-deoxy-2'-fluoro nucleoside"
  modified_base 1,3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 595 - DNA, 26 bp, artificial sequence
  LPA RNAi agent antisense strand
  modified_base 2,4,6,14,16: /mod_base = "2'-deoxy-2'-fluoro nucleoside"
  modified_base 3,5,7,8,9,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 596 - DNA, 26 bp, artificial sequence
  LPA RNAi agent antisense strand
  modified_base 2,4,6,14,16: /mod_base = "2'-deoxy-2'-fluoro nucleoside"
  modified_base 1,3,5,7,8,9,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 597 - DNA, 26 bp, artificial sequence
  LPA RNAi agent antisense strand
  modified_base 2,4,6,8,10,14,16: /mod_base = "2'-deoxy-2'-fluoro nucleoside"
  modified_base 3,5,7,9,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 598 - DNA, 26 bp, artificial sequence
  LPA RNAi agent antisense strand
  modified_base 2,4,6,8,10,14,16: /mod_base = "2'-deoxy-2'-fluoro nucleoside"
  modified_base 1,3,5,7,9,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 599 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 1,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 600 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 601 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,24,26: /mod_base = "2'-O-methyl nucleoside"
  modified_base 22,23: /mod_base = "2'-MOE nucleoside"
  modified_base 25: /mod_base = "2'-hydroxy nucleoside"
  modified_base 2,3,23,24: /mod_base = "phosphorothioate linked nucleoside"
ugagaaugagccucgauaacuctuau

SEQ ID NO: 602 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,24,26: /mod_base = "2'-O-methyl nucleoside"
  modified_base 22,23: /mod_base = "2'-MOE nucleoside"
  modified_base 25: /mod_base = "2'-hydroxy nucleoside"
  modified_base 2,3: /mod_base = "phosphorothioate linked nucleoside"
ugagaaugagccucgauaacuctuau

SEQ ID NO: 603 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3: /mod_base = "phosphorothioate linked nucleoside"
ugagaaugagccucgauaacucuuau

SEQ ID NO: 604 - DNA, 26 bp, artificial sequence
  LPA RNAi agent antisense strand
  modified_base 2,4,6,8,9,10,14,16,18,20,22: /mod_base = "2'-deoxy-2'-fluoro nucleoside"
  modified_base 1,3,5,7,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 605 - DNA, 26 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 606 - DNA, 26 bp, artificial sequence
  LPA RNAi agent antisense strand
  modified_base 2,4,6,8,10,11,14,16,18,20,22: /mod_base = "2'-deoxy-2'-fluoro nucleoside"
  modified_base 1,3,5,7,9,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 607 - DNA, 26 bp, artificial sequence
  LPA RNAi agent antisense strand
  modified_base 2,4,6,8,10,11,12,14,16,18,20,22: /mod_base = "2'-deoxy-2'-fluoro nucleoside"
  modified_base 1,3,5,7,9,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 608 - DNA, 26 bp, artificial sequence
  LPA RNAi agent antisense strand
  modified_base 2,6,10,14,16,20,22: /mod_base = "2'-deoxy-2'-fluoro nucleoside"
  modified_base 1,3,4,5,7,8,9,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 609 - DNA, 26 bp, artificial sequence
  LPA RNAi agent antisense strand
  modified_base 2,8,14,18,20,22: /mod_base = "2'-deoxy-2'-fluoro nucleoside"
  modified_base 1,3,4,5,6,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 610 - DNA, 26 bp, artificial sequence
  LPA RNAi agent antisense strand
  modified_base 2,8,14,18: /mod_base = "2'-deoxy-2'-fluoro nucleoside"
  modified_base 1,3,4,5,6,7,9,10,11,12,13,15,16,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 611 - DNA, 26 bp, artificial sequence
  LPA RNAi agent antisense strand
  modified_base 2,4,6,10,14,20,22: /mod_base = "2'-deoxy-2'-fluoro nucleoside"
  modified_base 1,3,5,7,8,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 612 - DNA, 26 bp, artificial sequence
  LPA RNAi agent antisense strand
  modified_base 2,14,20,22: /mod_base = "2'-deoxy-2'-fluoro nucleoside"
  modified_base 1,3,4,5,6,7,8,9,10,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 613 - DNA, 26 bp, artificial sequence
  LPA RNAi agent antisense strand
  modified_base 2,14,22: /mod_base = "2'-deoxy-2'-fluoro nucleoside"
  modified_base 1,3,4,5,6,7,8,9,10,11,12,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 614 - DNA, 26 bp, artificial sequence
  LPA RNAi agent antisense strand
  modified_base 2,14,20: /mod_base = "2'-deoxy-2'-fluoro nucleoside"
  modified_base 1,3,4,5,6,7,8,9,10,11,12,13,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 615 - DNA, 26 bp, artificial sequence
  LPA RNAi agent antisense strand
  modified_base 2,14: /mod_base = "2'-deoxy-2'-fluoro nucleoside"
  modified_base 1,3,4,5,6,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 616 - DNA, 26 bp, artificial sequence
  LPA RNAi agent antisense strand
  modified_base 2,4,6,10,13,14,20,22: /mod_base = "2'-deoxy-2'-fluoro nucleoside"
  modified_base 1,3,5,7,8,9,11,12,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 617 - DNA, 26 bp, artificial sequence
  LPA RNAi agent antisense strand
  modified_base 2,13,14,20,22: /mod_base = "2'-deoxy-2'-fluoro nucleoside"
  modified_base 1,3,4,5,6,7,8,9,10,11,12,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 618 - DNA, 26 bp, artificial sequence
  LPA RNAi agent antisense strand
  modified_base 2,13,14,22: /mod_base = "2'-deoxy-2'-fluoro nucleoside"
  modified_base 1,3,4,5,6,7,8,9,10,11,12,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 619 - DNA, 26 bp, artificial sequence
  LPA RNAi agent antisense strand
  modified_base 2,13,14,20: /mod_base = "2'-deoxy-2'-fluoro nucleoside"
  modified_base 1,3,4,5,6,7,8,9,10,11,12,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 620 - DNA, 26 bp, artificial sequence
  LPA RNAi agent antisense strand
  modified_base 2,13,14: /mod_base = "2'-deoxy-2'-fluoro nucleoside"
  modified_base 1,3,4,5,6,7,8,9,10,11,12,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 621 - DNA, 26 bp, artificial sequence
  LPA RNAi agent antisense strand
  modified_base 2,4,6,10,12,14,20,22: /mod_base = "2'-deoxy-2'-fluoro nucleoside"
  modified_base 1,3,5,7,8,9,11,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 622 - DNA, 26 bp, artificial sequence
  LPA RNAi agent antisense strand
  modified_base 2,12,14,20,22: /mod_base = "2'-deoxy-2'-fluoro nucleoside"
  modified_base 1,3,4,5,6,7,8,9,10,11,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 623 - DNA, 26 bp, artificial sequence
  LPA RNAi agent antisense strand
  modified_base 2,12,14,22: /mod_base = "2'-deoxy-2'-fluoro nucleoside"
  modified_base 1,3,4,5,6,7,8,9,10,11,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 624 - DNA, 26 bp, artificial sequence
  LPA RNAi agent antisense strand
  modified_base 2,12,14,20: /mod_base = "2'-deoxy-2'-fluoro nucleoside"
  modified_base 1,3,4,5,6,7,8,9,10,11,13,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 625 - DNA, 26 bp, artificial sequence
  LPA RNAi agent antisense strand
  modified_base 2,12,14: /mod_base = "2'-deoxy-2'-fluoro nucleoside"
  modified_base 1,3,4,5,6,7,8,9,10,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 626 - DNA, 26 bp, artificial sequence
  LPA RNAi agent antisense strand
  modified_base 2,4,6,10,11,14,20,22: /mod_base = "2'-deoxy-2'-fluoro nucleoside"
  modified_base 1,3,5,7,8,9,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 627 - DNA, 26 bp, artificial sequence
  LPA RNAi agent antisense strand
  modified_base 2,11,14,20,22: /mod_base = "2'-deoxy-2'-fluoro nucleoside"
  modified_base 1,3,4,5,6,7,8,9,10,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 628 - DNA, 26 bp, artificial sequence
  LPA RNAi agent antisense strand
  modified_base 2,11,14,22: /mod_base = "2'-deoxy-2'-fluoro nucleoside"
  modified_base 1,3,4,5,6,7,8,9,10,12,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 629 - DNA, 26 bp, artificial sequence
  LPA RNAi agent antisense strand
  modified_base 2,11,14,20: /mod_base = "2'-deoxy-2'-fluoro nucleoside"
  modified_base 1,3,4,5,6,7,8,9,10,12,13,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 630 - DNA, 26 bp, artificial sequence
  LPA RNAi agent antisense strand
  modified_base 2,11,14: /mod_base = "2'-deoxy-2'-fluoro nucleoside"
  modified_base 1,3,4,5,6,7,8,9,10,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 631 - DNA, 26 bp, artificial sequence
  LPA RNAi agent antisense strand
  modified_base 2,4,6,14,16,18,20,22: /mod_base = "2'-deoxy-2'-fluoro nucleoside"
  modified_base 1,3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 632 - DNA, 26 bp, artificial sequence
  LPA RNAi agent antisense strand
  modified_base 2,4,6,8,10,14,20,22: /mod_base = "2'-deoxy-2'-fluoro nucleoside"
  modified_base 1,3,5,7,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 633 - DNA, 26 bp, artificial sequence
  LPA RNAi agent antisense strand
  modified_base 2,8,10,14,16,18,20,22: /mod_base = "2'-deoxy-2'-fluoro nucleoside"
  modified_base 1,3,4,5,6,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 634 - DNA, 26 bp, artificial sequence
  LPA RNAi agent antisense strand
  modified_base 2,4,6,8,10,14,16,18: /mod_base = "2'-deoxy-2'-fluoro nucleoside"
  modified_base 1,3,5,7,9,11,12,13,15,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 635 - DNA, 26 bp, artificial sequence
  LPA RNAi agent antisense strand
  modified_base 2,4,6,14,16,18: /mod_base = "2'-deoxy-2'-fluoro nucleoside"
  modified_base 1,3,5,7,8,9,10,11,12,13,15,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 636 - DNA, 26 bp, artificial sequence
  LPA RNAi agent antisense strand
  modified_base 2,8,10,14,20,22: /mod_base = "2'-deoxy-2'-fluoro nucleoside"
  modified_base 1,3,4,5,6,7,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 637 - DNA, 26 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 638 - DNA, 26 bp, artificial sequence
  LPA RNAi agent antisense strand
  modified_base 2,8,10,12,14,20,22: /mod_base = "2'-deoxy-2'-fluoro nucleoside"
  modified_base 1,3,4,5,6,7,9,11,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 639 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17,19: /mod_base = "2'-O-methyl nucleoside"
  modified_base 2,3,20,21: /mod_base = "phosphorothioate linked nucleoside"
ugagaaugagccucgauaatt

SEQ ID NO: 640 - DNA, 26 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 641 - DNA, 26 bp, artificial sequence
  LPA RNAi agent antisense strand
  modified_base 2,14: /mod_base = "2'-deoxy-2'-fluoro nucleoside"
  modified_base 1,3,4,5,6,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 642 - DNA, 26 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 643 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2: /mod_base = "phosphorothioate linked nucleoside"
tgagaaugagccucgauaacucuuau

SEQ ID NO: 644 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 3,5,7,9,11,12,13,15,17,19,21,22,23,24,26: /mod_base = "2'-O-methyl nucleoside"
  modified_base 25: /mod_base = "2'-hydroxy nucleoside"
  modified_base 3,23,24: /mod_base = "phosphorothioate linked nucleoside"
  modified_base 26: /mod_base = "3' end Vinyl Phosphonate modification"
tgagaaugagccucgauaacucuuau

SEQ ID NO: 645 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 26: /mod_base = "3' end Vinyl Phosphonate modification"
tgagaaugagccucgauaacucuuau

SEQ ID NO: 646 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 647 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 3,23,24: /mod_base = "phosphorothioate linked nucleoside"
  modified_base 26: /mod_base = "3' end Vinyl Phosphonate modification"
tcguauaacaauaaggggcugccuau

SEQ ID NO: 648 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 26: /mod_base = "3' end Vinyl Phosphonate modification"
tcguauaacaauaaggggcugccuau

SEQ ID NO: 649 - DNA, 26 bp, artificial sequence
  LPA RNAi agent antisense strand
  modified_base 2,3,14: /mod_base = "2'-deoxy-2'-fluoro nucleoside"
  modified_base 1,4,5,6,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 650 - DNA, 26 bp, artificial sequence
  LPA RNAi agent antisense strand
  modified_base 2,4,14: /mod_base = "2'-deoxy-2'-fluoro nucleoside"
  modified_base 1,3,5,6,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 651 - DNA, 26 bp, artificial sequence
  LPA RNAi agent antisense strand
  modified_base 2,5,14: /mod_base = "2'-deoxy-2'-fluoro nucleoside"
  modified_base 1,3,4,6,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 652 - DNA, 26 bp, artificial sequence
  LPA RNAi agent antisense strand
  modified_base 2,6,14: /mod_base = "2'-deoxy-2'-fluoro nucleoside"
  modified_base 1,3,4,5,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 653 - DNA, 26 bp, artificial sequence
  LPA RNAi agent antisense strand
  modified_base 2,7,14: /mod_base = "2'-deoxy-2'-fluoro nucleoside"
  modified_base 1,3,4,5,6,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 654 - DNA, 26 bp, artificial sequence
  LPA RNAi agent antisense strand
  modified_base 2,8,14: /mod_base = "2'-deoxy-2'-fluoro nucleoside"
  modified_base 1,3,4,5,6,7,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 655 - DNA, 26 bp, artificial sequence
  LPA RNAi agent antisense strand
  modified_base 2,10,14: /mod_base = "2'-deoxy-2'-fluoro nucleoside"
  modified_base 1,3,4,5,6,7,8,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 656 - DNA, 26 bp, artificial sequence
  LPA RNAi agent antisense strand
  modified_base 2,4,6,8,10,14,16,18,20,22: /mod_base = "2'-deoxy-2'-fluoro nucleoside"
  modified_base 1,3,5,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggcgcugccuau

SEQ ID NO: 657 - DNA, 26 bp, artificial sequence
  LPA RNAi agent antisense strand
  modified_base 2,4,6,8,10,14,19,22: /mod_base = "2'-deoxy-2'-fluoro nucleoside"
  modified_base 1,3,5,7,9,11,12,13,15,16,17,18,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 658 - DNA, 26 bp, artificial sequence
  LPA RNAi agent antisense strand
  modified_base 2,4,6,8,10,14: /mod_base = "2'-deoxy-2'-fluoro nucleoside"
  modified_base 1,3,5,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 659 - DNA, 26 bp, artificial sequence
  LPA RNAi agent antisense strand
  modified_base 2,3,8,10,14: /mod_base = "2'-deoxy-2'-fluoro nucleoside"
  modified_base 1,4,5,6,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 660 - DNA, 26 bp, artificial sequence
  LPA RNAi agent antisense strand
  modified_base 2,4,6,8,14: /mod_base = "2'-deoxy-2'-fluoro nucleoside"
  modified_base 1,3,5,7,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 661 - DNA, 26 bp, artificial sequence
  LPA RNAi agent antisense strand
  modified_base 2,4,6,9,14: /mod_base = "2'-deoxy-2'-fluoro nucleoside"
  modified_base 1,3,5,7,8,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 662 - DNA, 26 bp, artificial sequence
  LPA RNAi agent antisense strand
  modified_base 2,3,7,9,14: /mod_base = "2'-deoxy-2'-fluoro nucleoside"
  modified_base 1,4,5,6,8,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 663 - DNA, 26 bp, artificial sequence
  LPA RNAi agent antisense strand
  modified_base 2,4,6,8,10,14: /mod_base = "2'-deoxy-2'-fluoro nucleoside"
  modified_base 1,3,5,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 664 - DNA, 26 bp, artificial sequence
  LPA RNAi agent antisense strand
  modified_base 2,3,6,8,10,14: /mod_base = "2'-deoxy-2'-fluoro nucleoside"
  modified_base 1,4,5,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 665 - DNA, 26 bp, artificial sequence
  LPA RNAi agent antisense strand
  modified_base 2,3,5,8,10,12,14: /mod_base = "2'-deoxy-2'-fluoro nucleoside"
  modified_base 1,4,6,7,9,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 666 - DNA, 26 bp, artificial sequence
  LPA RNAi agent antisense strand
  modified_base 2,3,5,8,11,12,14: /mod_base = "2'-deoxy-2'-fluoro nucleoside"
  modified_base 1,4,6,7,9,10,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 667 - DNA, 26 bp, artificial sequence
  LPA RNAi agent antisense strand
  modified_base 2,4,6,8,14: /mod_base = "2'-deoxy-2'-fluoro nucleoside"
  modified_base 1,3,5,7,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 668 - DNA, 17 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17: /mod_base = "2'-O-methyl nucleoside"
  modified_base 2,3: /mod_base = "phosphorothioate linked nucleoside"
uguauaacaauaagggg

SEQ ID NO: 669 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
uguauaacaauaagggg

SEQ ID NO: 670 - DNA, 17 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17: /mod_base = "2'-O-methyl nucleoside"
  modified_base 2,3: /mod_base = "phosphorothioate linked nucleoside"
ucguauaacaauaaggg

SEQ ID NO: 671 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ucguauaacaauaaggg

SEQ ID NO: 672 - DNA, 17 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17: /mod_base = "2'-O-methyl nucleoside"
  modified_base 2,3: /mod_base = "phosphorothioate linked nucleoside"
ugagaaugagccucgau

SEQ ID NO: 673 - DNA, 17 bp, artificial sequence
  LPA RNAi agent antisense strand
  modified_base 2,12,14: /mod_base = "2'-deoxy-2'-fluoro nucleoside"
  modified_base 1,3,4,5,6,7,8,9,10,11,13,15,16,17: /mod_base = "2'-O-methyl nucleoside"
  modified_base 2,3: /mod_base = "phosphorothioate linked nucleoside"
ugagaaugagccucgau

SEQ ID NO: 674 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ugagaaugagccucgat

SEQ ID NO: 675 - DNA, 17 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17: /mod_base = "2'-O-methyl nucleoside"
  modified_base 2,3: /mod_base = "phosphorothioate linked nucleoside"
ugacaccugauucuguu

SEQ ID NO: 676 - DNA, 17 bp, artificial sequence
  LPA RNAi agent antisense strand
  modified_base 2,4,6,14: /mod_base = "2'-deoxy-2'-fluoro nucleoside"
  modified_base 1,3,5,7,8,9,10,11,12,13,15,16,17: /mod_base = "2'-O-methyl nucleoside"
  modified_base 2,3: /mod_base = "phosphorothioate linked nucleoside"
ugacaccugauucuguu

SEQ ID NO: 677 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ugacaccugauucugtt

SEQ ID NO: 678 - DNA, 26 bp, artificial sequence
  LPA RNAi agent antisense strand
  modified_base 4,6,8,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 2: /mod_base = "2'-F-Arabino nucleoside"
ucguauaacaauaaggggcugccuau

SEQ ID NO: 679 - DNA, 26 bp, artificial sequence
  LPA RNAi agent antisense strand
  modified_base 2,6,8,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 4: /mod_base = "2'-F-Arabino nucleoside"
ucguauaacaauaaggggcugccuau

SEQ ID NO: 680 - DNA, 26 bp, artificial sequence
  LPA RNAi agent antisense strand
  modified_base 2,4,8,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 6: /mod_base = "2'-F-Arabino nucleoside"
ucguauaacaauaaggggcugccuau

SEQ ID NO: 681 - DNA, 26 bp, artificial sequence
  LPA RNAi agent antisense strand
  modified_base 2,4,6,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 8: /mod_base = "2'-F-Arabino nucleoside"
ucguauaacaauaaggggcugccuau

SEQ ID NO: 682 - DNA, 26 bp, artificial sequence
  LPA RNAi agent antisense strand
  modified_base 8,10,14: /mod_base = "2'-deoxy-2'-fluoro nucleoside"
  modified_base 1,3,4,5,6,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 2: /mod_base = "2'-F-Arabino nucleoside"
ugagaaugagccucgauaacucuuau

SEQ ID NO: 683 - DNA, 26 bp, artificial sequence
  LPA RNAi agent antisense strand
  modified_base 2,10,14: /mod_base = "2'-deoxy-2'-fluoro nucleoside"
  modified_base 1,3,4,5,6,7,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 8: /mod_base = "2'-F-Arabino nucleoside"
ugagaaugagccucgauaacucuuau

SEQ ID NO: 684 - DNA, 26 bp, artificial sequence
  LPA RNAi agent antisense strand
  modified_base 2,8,10,14: /mod_base = "2'-deoxy-2'-fluoro nucleoside"
  modified_base 3,4,5,6,7,9,11,12,13,15,16,17,18,19,20,21,22,23,24,26: /mod_base = "2'-O-methyl nucleoside"
  modified_base 1: /mod_base = "2'-MOE nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 685 - DNA, 26 bp, artificial sequence
  LPA RNAi agent antisense strand
  modified_base 2,4,6,8,9,10,14,16,18,20: /mod_base = "2'-deoxy-2'-fluoro nucleoside"
  modified_base 3,5,7,11,12,13,15,17,19,21,22,23,24,26: /mod_base = "2'-O-methyl nucleoside"
  modified_base 1: /mod_base = "2'-MOE nucleoside"
  modified_base 25: /mod_base = "2'-hydroxy nucleoside"
  modified_base 2,3,23,24: /mod_base = "phosphorothioate linked nucleoside"
tcguauaacaauaaggggcugccuau

SEQ ID NO: 686 - DNA, 26 bp, artificial sequence
  LPA RNAi agent antisense strand
  modified_base 2,14: /mod_base = "2'-deoxy-2'-fluoro nucleoside"
  modified_base 3,4,5,6,7,8,9,10,11,12,13,15,16,17,18,19,20,21,22,23,24,26: /mod_base = "2'-O-methyl nucleoside"
  modified_base 1: /mod_base = "2'-MOE nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 687 - DNA, 26 bp, artificial sequence
  LPA RNAi agent antisense strand
  modified_base 2,4,6,14: /mod_base = "2'-deoxy-2'-fluoro nucleoside"
  modified_base 1,3,5,7,8,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 688 - DNA, 26 bp, artificial sequence
  LPA RNAi agent antisense strand
  modified_base 2,4,8,14: /mod_base = "2'-deoxy-2'-fluoro nucleoside"
  modified_base 1,3,5,6,7,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 689 - DNA, 26 bp, artificial sequence
  LPA RNAi agent antisense strand
  modified_base 2,4,10,14: /mod_base = "2'-deoxy-2'-fluoro nucleoside"
  modified_base 1,3,5,6,7,8,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 690 - DNA, 26 bp, artificial sequence
  LPA RNAi agent antisense strand
  modified_base 2,4,12,14: /mod_base = "2'-deoxy-2'-fluoro nucleoside"
  modified_base 1,3,5,6,7,8,9,10,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 691 - DNA, 26 bp, artificial sequence
  LPA RNAi agent antisense strand
  modified_base 2,6,8,14: /mod_base = "2'-deoxy-2'-fluoro nucleoside"
  modified_base 1,3,4,5,7,9,10,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 692 - DNA, 26 bp, artificial sequence
  LPA RNAi agent antisense strand
  modified_base 2,6,10,14: /mod_base = "2'-deoxy-2'-fluoro nucleoside"
  modified_base 1,3,4,5,7,8,9,11,12,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 693 - DNA, 26 bp, artificial sequence
  LPA RNAi agent antisense strand
  modified_base 2,6,12,14: /mod_base = "2'-deoxy-2'-fluoro nucleoside"
  modified_base 1,3,4,5,7,8,9,10,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 694 - DNA, 26 bp, artificial sequence
  LPA RNAi agent antisense strand
  modified_base 2,8,12,14: /mod_base = "2'-deoxy-2'-fluoro nucleoside"
  modified_base 1,3,4,5,6,7,9,10,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 695 - DNA, 26 bp, artificial sequence
  LPA RNAi agent antisense strand
  modified_base 2,10,12,14: /mod_base = "2'-deoxy-2'-fluoro nucleoside"
  modified_base 1,3,4,5,6,7,8,9,11,13,15,16,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 696 - DNA, 26 bp, artificial sequence
  LPA RNAi agent antisense strand
  modified_base 2,4,6,8,10,12,14,18,20,22: /mod_base = "2'-deoxy-2'-fluoro nucleoside"
  modified_base 1,3,5,7,9,11,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 697 - DNA, 26 bp, artificial sequence
  LPA RNAi agent antisense strand
  modified_base 2,4,6,8,10,12,14,16,20,22: /mod_base = "2'-deoxy-2'-fluoro nucleoside"
  modified_base 1,3,5,7,9,11,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 698 - DNA, 26 bp, artificial sequence
  LPA RNAi agent antisense strand
  modified_base 2,4,6,8,10,12,14,16,18,22: /mod_base = "2'-deoxy-2'-fluoro nucleoside"
  modified_base 1,3,5,7,9,11,13,15,17,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 699 - DNA, 26 bp, artificial sequence
  LPA RNAi agent antisense strand
  modified_base 2,4,6,8,10,12,14,16,18,20: /mod_base = "2'-deoxy-2'-fluoro nucleoside"
  modified_base 1,3,5,7,9,11,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 700 - DNA, 24 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24: /mod_base = "2'-O-methyl nucleoside"
  modified_base 2,3,4,23,24: /mod_base = "phosphorothioate linked nucleoside"
  modified_base 1: /mod_base = "5' end Vinyl Phosphonate modification"
ucguauaacaauaaggggcugauu

SEQ ID NO: 701 - DNA, 24 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24: /mod_base = "2'-O-methyl nucleoside"
  modified_base 2,3,4,23,24: /mod_base = "phosphorothioate linked nucleoside"
  modified_base 1: /mod_base = "5' end Vinyl Phosphonate modification"
ucguauaacaauaaggggcugcuu

SEQ ID NO: 702 - DNA, 24 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17,18,19,20,21,22,23,24: /mod_base = "2'-O-methyl nucleoside"
  modified_base 2,3,4,23,24: /mod_base = "phosphorothioate linked nucleoside"
  modified_base 1: /mod_base = "5' end Vinyl Phosphonate modification"
ugagaaugagccucgauaacucuu

SEQ ID NO: 703 - DNA, 26 bp, artificial sequence
  LPA RNAi agent antisense strand
  modified_base 2,6,8,14,16: /mod_base = "2'-deoxy-2'-fluoro nucleoside"
  modified_base 1,3,4,5,7,9,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 704 - DNA, 26 bp, artificial sequence
  LPA RNAi agent antisense strand
  modified_base 2,6,8,9,14,16: /mod_base = "2'-deoxy-2'-fluoro nucleoside"
  modified_base 1,3,4,5,7,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 705 - DNA, 26 bp, artificial sequence
  LPA RNAi agent antisense strand
  modified_base 2,6,8,14,16: /mod_base = "2'-deoxy-2'-fluoro nucleoside"
  modified_base 1,3,4,5,7,9,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 706 - DNA, 26 bp, artificial sequence
  LPA RNAi agent antisense strand
  modified_base 2,6,8,9,14,16: /mod_base = "2'-deoxy-2'-fluoro nucleoside"
  modified_base 1,3,4,5,7,10,11,12,13,15,17,18,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 707 - DNA, 26 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end Vinyl Phosphonate modification"
ucguauaacaauaaggggcugccuau

SEQ ID NO: 708 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 1,3,5,7,11,12,13,15,17,19,20,21: /mod_base = "2'-O-methyl nucleoside"
  modified_base 2,3,4,21: /mod_base = "phosphorothioate linked nucleoside"
  modified_base 1: /mod_base = "5' end Vinyl Phosphonate modification"
ucguauaacaauaaggggcuu

SEQ ID NO: 709 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 1,3,5,7,11,12,13,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 710 - DNA, 21 bp, artificial sequence
  LPA RNAi agent antisense strand
  modified_base 1: /mod_base = "2'-3' seco nucleoside"
  modified_base 2,4,6,8,9,10,14,16,18: /mod_base = "2'-deoxy-2'-fluoro nucleoside"
  modified_base 3,5,7,11,12,13,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 711 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 712 - DNA, 26 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17,18,19,20,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 713 - DNA, 26 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 714 - DNA, 26 bp, artificial sequence
  LPA RNAi agent antisense strand
  modified_base 2,8,9,10,14: /mod_base = "2'-deoxy-2'-fluoro nucleoside"
  modified_base 1,3,4,5,6,7,11,12,13,15,16,17,18,19,20,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 715 - DNA, 26 bp, artificial sequence
  LPA RNAi agent antisense strand
  modified_base 2,4,6,8,9,14,16,18,20: /mod_base = "2'-deoxy-2'-fluoro nucleoside"
  modified_base 1,3,5,7,10,11,12,13,15,17,19,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 716 - DNA, 26 bp, artificial sequence
  LPA RNAi agent antisense strand
  modified_base 2,8,9,14: /mod_base = "2'-deoxy-2'-fluoro nucleoside"
  modified_base 1,3,4,5,6,7,10,11,12,13,15,16,17,18,19,20,21,22,23,24,25,26: /mod_base = "2'-O-methyl nucleoside"
  modified_base 2,3,23,24: /mod_base = "phosphorothioate linked nucleoside"
ugagaaugagccucgauaacucuuau

SEQ ID NO: 717 - DNA, 26 bp, artificial sequence
  LPA RNAi agent antisense strand
  modified_base 2,8,10,14: /mod_base = "2'-deoxy-2'-fluoro nucleoside"
  modified_base 1,3,4,5,6,7,9,11,12,13,15,16,17,18,19,20,21,22,23,24,25,26: /mod_base = "2'-O-methyl nucleoside"
  modified_base 2,3,23,24: /mod_base = "phosphorothioate linked nucleoside"
  modified_base 26: /mod_base = "3' end (Dy540) modification"
ugagaaugagccucgauaacucuuau

SEQ ID NO: 718 - DNA, 26 bp, artificial sequence
  LPA RNAi agent antisense strand
  modified_base 2,4,6,9,12,14,16,18,20,22: /mod_base = "2'-deoxy-2'-fluoro nucleoside"
  modified_base 1,3,5,7,8,10,11,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 719 - DNA, 26 bp, artificial sequence
  LPA RNAi agent antisense strand
  modified_base 2,8,12,14,22: /mod_base = "2'-deoxy-2'-fluoro nucleoside"
  modified_base 1,3,4,5,6,7,9,10,11,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 720 - DNA, 26 bp, artificial sequence
  LPA RNAi agent antisense strand
  modified_base 2,9,12,14,22: /mod_base = "2'-deoxy-2'-fluoro nucleoside"
  modified_base 1,3,4,5,6,7,8,10,11,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 721 - DNA, 26 bp, artificial sequence
  LPA RNAi agent antisense strand
  modified_base 2,9,12,14,19,22: /mod_base = "2'-deoxy-2'-fluoro nucleoside"
  modified_base 1,3,4,5,6,7,8,10,11,13,15,16,17,18,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 722 - DNA, 26 bp, artificial sequence
  LPA RNAi agent antisense strand
  modified_base 2,6,9,12,14,19,22: /mod_base = "2'-deoxy-2'-fluoro nucleoside"
  modified_base 1,3,4,5,7,8,10,11,13,15,16,17,18,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 723 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
uguauaacaauaagggg

SEQ ID NO: 724 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (Sp18)s(PAZ) modification"
uguauaacaauaagggg

SEQ ID NO: 725 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (C12)s(PAZ) modification"
uguauaacaauaagggg

SEQ ID NO: 726 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ucguauaacaauaaggg

SEQ ID NO: 727 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (Sp18)s(PAZ) modification"
ucguauaacaauaaggg

SEQ ID NO: 728 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (C12)s(PAZ) modification"
ucguauaacaauaaggg

SEQ ID NO: 729 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ugagaaugagccucgat

SEQ ID NO: 730 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (Sp18)s(PAZ) modification"
ugagaaugagccucgac

SEQ ID NO: 731 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (C12)s(PAZ) modification"
ugagaaugagccucgac

SEQ ID NO: 732 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
ugacaccugauucugtt

SEQ ID NO: 733 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (Sp18)s(PAZ) modification"
ugacaccugauucugtc

SEQ ID NO: 734 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (C12)s(PAZ) modification"
ugacaccugauucugtc

SEQ ID NO: 735 - DNA, 26 bp, artificial sequence
  LPA RNAi agent antisense strand
  modified_base 3,5,7,13,15,17,19,21,23: /mod_base = "2'-deoxy-2'-fluoro nucleoside"
  modified_base 2,4,6,8,9,10,11,12,14,16,18,20,22,24,25,26: /mod_base = "2'-O-methyl nucleoside"
  modified_base 3,4,24,25: /mod_base = "phosphorothioate linked nucleoside"
tucguauaacaauaaggggcugccua

SEQ ID NO: 736 - DNA, 26 bp, artificial sequence
  LPA RNAi agent antisense strand
  modified_base 4,6,8,14,16,18,20,22,24: /mod_base = "2'-deoxy-2'-fluoro nucleoside"
  modified_base 1,3,5,7,9,10,11,12,13,15,17,19,21,23,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
uaucguauaacaauaaggggcugccu

SEQ ID NO: 737 - DNA, 26 bp, artificial sequence
  LPA RNAi agent antisense strand
  modified_base 3,5,7,13,15,17,19,21,23: /mod_base = "2'-deoxy-2'-fluoro nucleoside"
  modified_base 2,4,6,8,9,10,11,12,14,16,18,20,22,24,25,26: /mod_base = "2'-O-methyl nucleoside"
  modified_base 3,4,24,25: /mod_base = "phosphorothioate linked nucleoside"
tccguauaacaauaaggggcugccua

SEQ ID NO: 738 - DNA, 26 bp, artificial sequence
  LPA RNAi agent antisense strand
  modified_base 4,6,8,14,16,18,20,22,24: /mod_base = "2'-deoxy-2'-fluoro nucleoside"
  modified_base 1,3,5,7,9,10,11,12,13,15,17,19,21,23,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
cuccguauaacaauaaggggcugccu

SEQ ID NO: 739 - DNA, 26 bp, artificial sequence
  LPA RNAi agent antisense strand
  modified_base 3,5,7,9,11,15,17,19,21: /mod_base = "2'-deoxy-2'-fluoro nucleoside"
  modified_base 2,4,6,8,10,12,13,14,16,18,20,22,23,24,25,26: /mod_base = "2'-O-methyl nucleoside"
  modified_base 3,4,24,25: /mod_base = "phosphorothioate linked nucleoside"
tugagaaugagccucgauaacucuua

SEQ ID NO: 740 - DNA, 26 bp, artificial sequence
  LPA RNAi agent antisense strand
  modified_base 4,6,8,10,12,16,18,20,22: /mod_base = "2'-deoxy-2'-fluoro nucleoside"
  modified_base 1,3,5,7,9,11,13,14,15,17,19,21,23,24,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
uaugagaaugagccucgauaacucuu

SEQ ID NO: 741 - DNA, 26 bp, artificial sequence
  LPA RNAi agent antisense strand
  modified_base 3,5,7,9,11,15,17,19,21: /mod_base = "2'-deoxy-2'-fluoro nucleoside"
  modified_base 2,4,6,8,10,12,13,14,16,18,20,22,23,24,25,26: /mod_base = "2'-O-methyl nucleoside"
  modified_base 3,4,24,25: /mod_base = "phosphorothioate linked nucleoside"
tggagaaugagccucgauaacucuua

SEQ ID NO: 742 - DNA, 26 bp, artificial sequence
  LPA RNAi agent antisense strand
  modified_base 4,6,8,10,12,16,18,20,22: /mod_base = "2'-deoxy-2'-fluoro nucleoside"
  modified_base 1,3,5,7,9,11,13,14,15,17,19,21,23,24,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
guggagaaugagccucgauaacucuu

SEQ ID NO: 743 - DNA, 26 bp, artificial sequence
  LPA RNAi agent antisense strand
  modified_base 3,9,11,15: /mod_base = "2'-deoxy-2'-fluoro nucleoside"
  modified_base 2,4,5,6,7,8,10,12,13,14,16,17,18,19,20,21,22,23,24,25,26: /mod_base = "2'-O-methyl nucleoside"
  modified_base 3,4,24,25: /mod_base = "phosphorothioate linked nucleoside"
tugagaaugagccucgauaacucuua

SEQ ID NO: 744 - DNA, 26 bp, artificial sequence
  LPA RNAi agent antisense strand
  modified_base 4,10,12,16: /mod_base = "2'-deoxy-2'-fluoro nucleoside"
  modified_base 1,3,5,6,7,8,9,11,13,14,15,17,18,19,20,21,22,23,24,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
uaugagaaugagccucgauaacucuu

SEQ ID NO: 745 - DNA, 26 bp, artificial sequence
  LPA RNAi agent antisense strand
  modified_base 3,9,11,15: /mod_base = "2'-deoxy-2'-fluoro nucleoside"
  modified_base 2,4,5,6,7,8,10,12,13,14,16,17,18,19,20,21,22,23,24,25,26: /mod_base = "2'-O-methyl nucleoside"
  modified_base 3,4,24,25: /mod_base = "phosphorothioate linked nucleoside"
tggagaaugagccucgauaacucuua

SEQ ID NO: 746 - DNA, 26 bp, artificial sequence
  LPA RNAi agent antisense strand
  modified_base 4,10,12,16: /mod_base = "2'-deoxy-2'-fluoro nucleoside"
  modified_base 1,3,5,6,7,8,9,11,13,14,15,17,18,19,20,21,22,23,24,25,26: /mod_base = "2'-O-methyl nucleoside"
  modified_base 2: /mod_base = "2'-hydroxy nucleoside"
  modified_base 4,5,25,26: /mod_base = "phosphorothioate linked nucleoside"
guggagaaugagccucgauaacucuu

SEQ ID NO: 747 - DNA, 21 bp, artificial sequence
  LPA RNAi agent antisense strand
  modified_base 2,4,6,12,14,16,18: /mod_base = "2'-deoxy-2'-fluoro nucleoside"
  modified_base 1,3,5,7,8,9,10,11,13,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 748 - DNA, 21 bp, artificial sequence
  LPA RNAi agent antisense strand
  modified_base 2,4,6,8,10,14,16,18: /mod_base = "2'-deoxy-2'-fluoro nucleoside"
  modified_base 1,3,5,7,9,11,12,13,15,17,19,20,21: /mod_base = "2'-O-methyl nucleoside"
  modified_base 2,3,4,21: /mod_base = "phosphorothioate linked nucleoside"
ugagaaugagccucgauaauu

SEQ ID NO: 749 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end s(C12)s(PAZ) modification"
uguauaacaauaagggg

SEQ ID NO: 750 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end s(C12)s(PAZ) modification"
ucguauaacaauaaggg

SEQ ID NO: 751 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end s(C12)s(PAZ) modification"
ugagaaugagccucgac

SEQ ID NO: 752 - DNA, 17 bp, artificial sequence
  LPA RNAi agent antisense strand
  modified_base 2,4,6,8,10,12,14: /mod_base = "2'-deoxy-2'-fluoro nucleoside"
  modified_base 1,3,5,7,9,11,13,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end s(C12)s(PAZ) modification"
ugacaccugauucugtc

SEQ ID NO: 753 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 3,5,7,11,12,13,15,17,19,20,21: /mod_base = "2'-O-methyl nucleoside"
  modified_base 1: /mod_base = "2'-MOE nucleoside"
  modified_base 2,3,4,21: /mod_base = "phosphorothioate linked nucleoside"
  modified_base 1: /mod_base = "5' end cyclopropyl phosphonate modification"
tcguauaacaauaaggggcuu

SEQ ID NO: 754 - DNA, 26 bp, artificial sequence
  LPA RNAi agent antisense strand
  modified_base 2,4,6,8,10,14,16,18: /mod_base = "2'-deoxy-2'-fluoro nucleoside"
  modified_base 1,3,5,7,9,11,12,13,15,17,19,20,21: /mod_base = "2'-O-methyl nucleoside"
  modified_base 22,23,24,25,26: /mod_base = "2'-hydroxy nucleoside"
  modified_base 2,3,4,21: /mod_base = "phosphorothioate linked nucleoside"
ugagaaugagccucgauaauuauaua

SEQ ID NO: 755 - DNA, 26 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24,26: /mod_base = "2'-O-methyl nucleoside"
  modified_base 25: /mod_base = "2'-hydroxy nucleoside"
  modified_base 2,3,22,23: /mod_base = "phosphorothioate linked nucleoside"
ucguauaacaauaaggggcugccuau

SEQ ID NO: 756 - DNA, 26 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24,26: /mod_base = "2'-O-methyl nucleoside"
  modified_base 25: /mod_base = "2'-hydroxy nucleoside"
  modified_base 2,3,22: /mod_base = "phosphorothioate linked nucleoside"
ucguauaacaauaaggggcugccuau

SEQ ID NO: 757 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,22,23: /mod_base = "phosphorothioate linked nucleoside"
ugagaaugagccucgauaacucuuau

SEQ ID NO: 758 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,22: /mod_base = "phosphorothioate linked nucleoside"
ugagaaugagccucgauaacucuuau

SEQ ID NO: 759 - DNA, 24 bp, artificial sequence
  LPA RNAi agent antisense strand
  modified_base 2,4,6,8,9,10,14,16,18,20: /mod_base = "2'-deoxy-2'-fluoro nucleoside"
  modified_base 1,3,5,7,11,12,13,15,17,19,21,22,23,24: /mod_base = "2'-O-methyl nucleoside"
  modified_base 2,3,4,23,24: /mod_base = "phosphorothioate linked nucleoside"
ucguauaacaauaaggggcugcuu

SEQ ID NO: 760 - DNA, 21 bp, artificial sequence
  LPA RNAi agent antisense strand
  modified_base 2,4,6,8,9,10,16,18: /mod_base = "2'-deoxy-2'-fluoro nucleoside"
  modified_base 1,3,5,7,11,12,13,14,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 761 - DNA, 21 bp, artificial sequence
  LPA RNAi agent antisense strand
  modified_base 2,4,6,8,9,10,12,16,18: /mod_base = "2'-deoxy-2'-fluoro nucleoside"
  modified_base 1,3,5,7,11,13,14,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 762 - DNA, 23 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23: /mod_base = "2'-O-methyl nucleoside"
  modified_base 2,3,22,23: /mod_base = "phosphorothioate linked nucleoside"
ucguauaacaauaaggggcugcc

SEQ ID NO: 763 - DNA, 24 bp, artificial sequence
  LPA RNAi agent antisense strand
  modified_base 3,5,7,13,15,17,19,21,23: /mod_base = "2'-deoxy-2'-fluoro nucleoside"
  modified_base 2,4,6,8,9,10,11,12,14,16,18,20,22,24: /mod_base = "2'-O-methyl nucleoside"
  modified_base 3,4,23,24: /mod_base = "phosphorothioate linked nucleoside"
tucguauaacaauaaggggcugcc

SEQ ID NO: 764 - DNA, 24 bp, artificial sequence
  LPA RNAi agent antisense strand
  modified_base 3,5,7,13,15,17,19,21: /mod_base = "2'-deoxy-2'-fluoro nucleoside"
  modified_base 2,4,6,8,9,10,11,12,14,16,18,20,22,23,24: /mod_base = "2'-O-methyl nucleoside"
  modified_base 3,4,23,24: /mod_base = "phosphorothioate linked nucleoside"
tucguauaacaauaaggggcugcc

SEQ ID NO: 765 - DNA, 24 bp, artificial sequence
  LPA RNAi agent antisense strand
  modified_base 3,5,7,13,15,17,19,21: /mod_base = "2'-deoxy-2'-fluoro nucleoside"
  modified_base 2,4,6,8,9,10,11,12,14,16,18,20,22,23,24: /mod_base = "2'-O-methyl nucleoside"
  modified_base 3,4,5,23,24: /mod_base = "phosphorothioate linked nucleoside"
tucguauaacaauaaggggcugcc

SEQ ID NO: 766 - DNA, 24 bp, artificial sequence
  LPA RNAi agent antisense strand
  modified_base 3,5,7,13,15,17,19,21: /mod_base = "2'-deoxy-2'-fluoro nucleoside"
  modified_base 2,4,6,8,9,10,11,12,14,16,18,20,22,23,24: /mod_base = "2'-O-methyl nucleoside"
  modified_base 3,4,5,24: /mod_base = "phosphorothioate linked nucleoside"
tucguauaacaauaaggggcugcc

SEQ ID NO: 767 - DNA, 22 bp, artificial sequence
  LPA RNAi agent antisense strand
  modified_base 3,5,7,13,15,17,19: /mod_base = "2'-deoxy-2'-fluoro nucleoside"
  modified_base 2,4,6,8,9,10,11,12,14,16,18,20,21,22: /mod_base = "2'-O-methyl nucleoside"
  modified_base 3,4,5,22: /mod_base = "phosphorothioate linked nucleoside"
tucguauaacaauaaggggcug

SEQ ID NO: 768 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 3,5,7,11,12,13,15,17,19,20,21: /mod_base = "2'-O-methyl nucleoside"
  modified_base 2,3,4,21: /mod_base = "phosphorothioate linked nucleoside"
  modified_base 1: /mod_base = "5' end ethyl phosphonate modification"
tcguauaacaauaaggggcuu

SEQ ID NO: 769 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 3,5,7,11,12,13,15,17,19,20,21: /mod_base = "2'-O-methyl nucleoside"
  modified_base 1: /mod_base = "2'-MOE nucleoside"
  modified_base 2,3,4,21: /mod_base = "phosphorothioate linked nucleoside"
  modified_base 1: /mod_base = "5' end ethyl phosphonate modification"
tcguauaacaauaaggggcuu

SEQ ID NO: 770 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,21,22: /mod_base = "phosphorothioate linked nucleoside"
ugagaaugagccucgauaacucuuau

SEQ ID NO: 771 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,20,21: /mod_base = "phosphorothioate linked nucleoside"
ugagaaugagccucgauaacucuuau

SEQ ID NO: 772 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacuaucgc

SEQ ID NO: 773 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacuauuca

SEQ ID NO: 774 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacuacgau

SEQ ID NO: 775 - DNA, 26 bp, artificial sequence
  LPA RNAi agent antisense strand
  modified_base 4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 2: /mod_base = "5'-methyl, 2'-fluoro nucleoside"
ugagaaugagccucgauaacucuuau

SEQ ID NO: 776 - DNA, 26 bp, artificial sequence
  LPA RNAi agent antisense strand
  modified_base 2,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 4: /mod_base = "5'-methyl, 2'-fluoro nucleoside"
ugagaaugagccucgauaacucuuau

SEQ ID NO: 777 - DNA, 26 bp, artificial sequence
  LPA RNAi agent antisense strand
  modified_base 2,4,6,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 8: /mod_base = "5'-methyl, 2'-fluoro nucleoside"
ugagaaugagccucgauaacucuuau

SEQ ID NO: 778 - DNA, 26 bp, artificial sequence
  LPA RNAi agent antisense strand
  modified_base 2,4,6,8,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 10: /mod_base = "5'-methyl, 2'-fluoro nucleoside"
ugagaaugagccucgauaacucuuau

SEQ ID NO: 779 - DNA, 21 bp, artificial sequence
  LPA RNAi agent antisense strand
  modified_base 2,4,6,8,9,10,14,16,18: /mod_base = "2'-deoxy-2'-fluoro nucleoside"
  modified_base 1,3,5,7,11,12,13,15,17,19,20,21: /mod_base = "2'-O-methyl nucleoside"
  modified_base 2,3,4,21: /mod_base = "phosphorothioate linked nucleoside"
  modified_base 1: /mod_base = "5' end Vinyl Phosphonate modification"
ucguauaacaauaaggggcgu

SEQ ID NO: 780 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24: /mod_base = "2'-O-methyl nucleoside"
  modified_base 2,3,23,24: /mod_base = "phosphorothioate linked nucleoside"
ucguauaacaauaaggggcugccu

SEQ ID NO: 781 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24: /mod_base = "2'-O-methyl nucleoside"
  modified_base 2,3,23,24: /mod_base = "phosphorothioate linked nucleoside"
ucguauaacaauaaggggcugcuu

SEQ ID NO: 782 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24: /mod_base = "2'-O-methyl nucleoside"
  modified_base 2,3,23,24: /mod_base = "phosphorothioate linked nucleoside"
  modified_base 1: /mod_base = "5' end Vinyl Phosphonate modification"
ucguauaacaauaaggggcugccu

SEQ ID NO: 783 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24: /mod_base = "2'-O-methyl nucleoside"
  modified_base 2,3,23,24: /mod_base = "phosphorothioate linked nucleoside"
  modified_base 1: /mod_base = "5' end Vinyl Phosphonate modification"
ucguauaacaauaaggggcugcuu

SEQ ID NO: 784 - DNA, 26 bp, artificial sequence
  LPA RNAi agent antisense strand
  modified_base 2,4,6,8,9,14,16,18,20,22: /mod_base = "2'-deoxy-2'-fluoro nucleoside"
  modified_base 1,3,5,7,10,11,12,13,15,17,19,21,23,24,26: /mod_base = "2'-O-methyl nucleoside"
  modified_base 25: /mod_base = "2'-hydroxy nucleoside"
  modified_base 2,3,22,23: /mod_base = "phosphorothioate linked nucleoside"
ugagaaugagccucgauaacucuuau

SEQ ID NO: 785 - DNA, 26 bp, artificial sequence
  LPA RNAi agent antisense strand
  modified_base 2,4,6,8,10,14,16,18,20: /mod_base = "2'-deoxy-2'-fluoro nucleoside"
  modified_base 1,3,5,7,9,11,12,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end cyclopropyl phosphonate modification"
ugagaaugagccucgauaacucuuau

SEQ ID NO: 786 - DNA, 26 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end cyclopropyl phosphonate modification"
ucguauaacaauaaggggcugccuau

SEQ ID NO: 787 - DNA, 21 bp, artificial sequence
  LPA RNAi agent antisense strand
  modified_base 2,4,6,12,14,16,18: /mod_base = "2'-deoxy-2'-fluoro nucleoside"
  modified_base 1,3,5,7,8,9,10,11,13,15,17,19,20,21: /mod_base = "2'-O-methyl nucleoside"
  modified_base 2,3,20,21: /mod_base = "phosphorothioate linked nucleoside"
ucguauaacaauaaggggcuu

SEQ ID NO: 788 - DNA, 21 bp, artificial sequence
  LPA RNAi agent antisense strand
  modified_base 2,4,6,12,14,16,18: /mod_base = "2'-deoxy-2'-fluoro nucleoside"
  modified_base 1,3,5,7,8,9,10,11,13,15,17,19,20,21: /mod_base = "2'-O-methyl nucleoside"
  modified_base 2,3,20,21: /mod_base = "phosphorothioate linked nucleoside"
  modified_base 1: /mod_base = "5' end cyclopropyl phosphonate modification"
ucguauaacaauaaggggcuu

SEQ ID NO: 789 - DNA, 21 bp, artificial sequence
  LPA RNAi agent antisense strand
  modified_base 2,4,6,12,14,16,18: /mod_base = "2'-deoxy-2'-fluoro nucleoside"
  modified_base 1,3,5,7,8,9,10,11,13,15,17,19,20,21: /mod_base = "2'-O-methyl nucleoside"
  modified_base 2,3,20,21: /mod_base = "phosphorothioate linked nucleoside"
ucguauaacaauaaggggcug

SEQ ID NO: 790 - DNA, 21 bp, artificial sequence
  LPA RNAi agent antisense strand
  modified_base 2,4,6,12,14,16,18,20: /mod_base = "2'-deoxy-2'-fluoro nucleoside"
  modified_base 1,3,5,7,8,9,10,11,13,15,17,19,21: /mod_base = "2'-O-methyl nucleoside"
  modified_base 2,3,20,21: /mod_base = "phosphorothioate linked nucleoside"
ucguauaacaauaaggggcug

SEQ ID NO: 791 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 1,3,5,7,8,9,10,11,13,15,17,19,21,23,24: /mod_base = "2'-O-methyl nucleoside"
  modified_base 2,3,23,24: /mod_base = "phosphorothioate linked nucleoside"
  modified_base 1: /mod_base = "5' end cyclopropyl phosphonate modification"
ucguauaacaauaaggggcugcuu

SEQ ID NO: 792 - DNA, 26 bp, artificial sequence
  LPA RNAi agent antisense strand
  modified_base 2,4,6,8,10,12,14,16,18,20: /mod_base = "2'-deoxy-2'-fluoro nucleoside"
  modified_base 1,3,5,7,9,11,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 793 - DNA, 26 bp, artificial sequence
  LPA RNAi agent antisense strand
  modified_base 2,4,6,8,10,12,14,16,18,20: /mod_base = "2'-deoxy-2'-fluoro nucleoside"
  modified_base 1,3,5,7,9,11,13,15,17,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end cyclopropyl phosphonate modification"
ugagaaugagccucgauaacucuuau

SEQ ID NO: 794 - DNA, 26 bp, artificial sequence
  LPA RNAi agent antisense strand
  modified_base 2,4,6,8,10,12,14,16,18,20: /mod_base = "2'-deoxy-2'-fluoro nucleoside"
  modified_base 3,5,7,9,11,13,15,17,19,21,22,23,24,26: /mod_base = "2'-O-methyl nucleoside"
  modified_base 1: /mod_base = "2'-MOE nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end cyclopropyl phosphonate modification"
tgagaaugagccucgauaacucuuau

SEQ ID NO: 795 - DNA, 26 bp, artificial sequence
  LPA RNAi agent antisense strand
  modified_base 2,4,6,12,14,16,18,20,22: /mod_base = "2'-deoxy-2'-fluoro nucleoside"
  modified_base 3,5,7,8,9,10,11,13,15,17,19,21,23,24,26: /mod_base = "2'-O-methyl nucleoside"
  modified_base 1: /mod_base = "2'-MOE nucleoside"
  modified_base 25: /mod_base = "2'-hydroxy nucleoside"
  modified_base 2,3,23,24: /mod_base = "phosphorothioate linked nucleoside"
  modified_base 1: /mod_base = "5' end cyclopropyl phosphonate modification"
tcguauaacaauaaggggcugccuau

SEQ ID NO: 796 - DNA, 21 bp, artificial sequence
  LPA RNAi agent antisense strand
  modified_base 2,4,6,12,14,16,18: /mod_base = "2'-deoxy-2'-fluoro nucleoside"
  modified_base 3,5,7,8,9,10,11,13,15,17,19,20,21: /mod_base = "2'-O-methyl nucleoside"
  modified_base 1: /mod_base = "2'-MOE nucleoside"
  modified_base 2,3,20,21: /mod_base = "phosphorothioate linked nucleoside"
  modified_base 1: /mod_base = "5' end cyclopropyl phosphonate modification"
tcguauaacaauaaggggcuu

SEQ ID NO: 797 - DNA, 24 bp, artificial sequence
  LPA RNAi agent antisense strand
  modified_base 2,4,6,12,14,16,18,20,22: /mod_base = "2'-deoxy-2'-fluoro nucleoside"
  modified_base 3,5,7,8,9,10,11,13,15,17,19,21,23,24: /mod_base = "2'-O-methyl nucleoside"
  modified_base 1: /mod_base = "2'-MOE nucleoside"
  modified_base 2,3,23,24: /mod_base = "phosphorothioate linked nucleoside"
  modified_base 1: /mod_base = "5' end cyclopropyl phosphonate modification"
tcguauaacaauaaggggcugcuu

SEQ ID NO: 798 - DNA, 21 bp, artificial sequence
  LPA RNAi agent antisense strand
  modified_base 2,4,6,8,10,12,14,16,18: /mod_base = "2'-deoxy-2'-fluoro nucleoside"
  modified_base 1,3,5,7,9,11,13,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 799 - DNA, 26 bp, artificial sequence
  LPA RNAi agent antisense strand
  modified_base 10,14,16,18,20,22: /mod_base = "2'-deoxy-2'-fluoro nucleoside"
  modified_base 1,2,3,4,5,6,7,8,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 800 - DNA, 26 bp, artificial sequence
  LPA RNAi agent antisense strand
  modified_base 8,14,16,18,20,22: /mod_base = "2'-deoxy-2'-fluoro nucleoside"
  modified_base 1,2,3,4,5,6,7,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 801 - DNA, 26 bp, artificial sequence
  LPA RNAi agent antisense strand
  modified_base 6,14,16,18,20,22: /mod_base = "2'-deoxy-2'-fluoro nucleoside"
  modified_base 1,2,3,4,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 802 - DNA, 26 bp, artificial sequence
  LPA RNAi agent antisense strand
  modified_base 4,14,16,18,20,22: /mod_base = "2'-deoxy-2'-fluoro nucleoside"
  modified_base 1,2,3,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 803 - DNA, 26 bp, artificial sequence
  LPA RNAi agent antisense strand
  modified_base 2,14,16,18,20,22: /mod_base = "2'-deoxy-2'-fluoro nucleoside"
  modified_base 1,3,4,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 804 - DNA, 26 bp, artificial sequence
  LPA RNAi agent antisense strand
  modified_base 14,16,18,20,22: /mod_base = "2'-deoxy-2'-fluoro nucleoside"
  modified_base 2,3,4,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 805 - DNA, 26 bp, artificial sequence
  LPA RNAi agent antisense strand
  modified_base 2,4,6,14,16,18,20,22: /mod_base = "2'-deoxy-2'-fluoro nucleoside"
  modified_base 3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 806 - DNA, 26 bp, artificial sequence
  LPA RNAi agent antisense strand
  modified_base 2,4,6,10,14,18,20,22: /mod_base = "2'-deoxy-2'-fluoro nucleoside"
  modified_base 3,5,7,8,9,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 807 - DNA, 26 bp, artificial sequence
  LPA RNAi agent antisense strand
  modified_base 2,4,6,8,14,18,20,22: /mod_base = "2'-deoxy-2'-fluoro nucleoside"
  modified_base 3,5,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 808 - DNA, 26 bp, artificial sequence
  LPA RNAi agent antisense strand
  modified_base 2,4,6,14,18,20,22: /mod_base = "2'-deoxy-2'-fluoro nucleoside"
  modified_base 3,5,7,8,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 809 - DNA, 26 bp, artificial sequence
  LPA RNAi agent antisense strand
  modified_base 2,4,6,14,16,20,22: /mod_base = "2'-deoxy-2'-fluoro nucleoside"
  modified_base 3,5,7,8,9,10,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 810 - DNA, 26 bp, artificial sequence
  LPA RNAi agent antisense strand
  modified_base 2,4,6,10,14,20,22: /mod_base = "2'-deoxy-2'-fluoro nucleoside"
  modified_base 3,5,7,8,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 811 - DNA, 26 bp, artificial sequence
  LPA RNAi agent antisense strand
  modified_base 2,4,6,8,14,20,22: /mod_base = "2'-deoxy-2'-fluoro nucleoside"
  modified_base 3,5,7,9,10,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 812 - DNA, 26 bp, artificial sequence
  LPA RNAi agent antisense strand
  modified_base 10,14,16,18,20,22: /mod_base = "2'-deoxy-2'-fluoro nucleoside"
  modified_base 2,3,4,5,6,7,8,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 813 - DNA, 26 bp, artificial sequence
  LPA RNAi agent antisense strand
  modified_base 8,14,16,18,20,22: /mod_base = "2'-deoxy-2'-fluoro nucleoside"
  modified_base 2,3,4,5,6,7,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 814 - DNA, 26 bp, artificial sequence
  LPA RNAi agent antisense strand
  modified_base 6,14,16,18,20,22: /mod_base = "2'-deoxy-2'-fluoro nucleoside"
  modified_base 2,3,4,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 815 - DNA, 26 bp, artificial sequence
  LPA RNAi agent antisense strand
  modified_base 4,14,16,18,20,22: /mod_base = "2'-deoxy-2'-fluoro nucleoside"
  modified_base 2,3,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 816 - DNA, 26 bp, artificial sequence
  LPA RNAi agent antisense strand
  modified_base 2,14,16,18,20,22: /mod_base = "2'-deoxy-2'-fluoro nucleoside"
  modified_base 3,4,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgagaaugagccucgauaacucuuau

SEQ ID NO: 817 - DNA, 26 bp, artificial sequence
  LPA RNAi agent antisense strand
  modified_base 14,16,18,20,22: /mod_base = "2'-deoxy-2'-fluoro nucleoside"
  modified_base 1,2,3,4,5,6,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 818 - DNA, 26 bp, artificial sequence
  LPA RNAi agent antisense strand
  modified_base 2,4,6,14,16,18,20,22: /mod_base = "2'-deoxy-2'-fluoro nucleoside"
  modified_base 1,3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 819 - DNA, 26 bp, artificial sequence
  LPA RNAi agent antisense strand
  modified_base 2,4,6,10,14,18,20,22: /mod_base = "2'-deoxy-2'-fluoro nucleoside"
  modified_base 1,3,5,7,8,9,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 820 - DNA, 26 bp, artificial sequence
  LPA RNAi agent antisense strand
  modified_base 2,4,6,8,14,18,20,22: /mod_base = "2'-deoxy-2'-fluoro nucleoside"
  modified_base 1,3,5,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 821 - DNA, 26 bp, artificial sequence
  LPA RNAi agent antisense strand
  modified_base 2,4,6,14,18,20,22: /mod_base = "2'-deoxy-2'-fluoro nucleoside"
  modified_base 1,3,5,7,8,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 822 - DNA, 26 bp, artificial sequence
  LPA RNAi agent antisense strand
  modified_base 2,4,6,14,16,20,22: /mod_base = "2'-deoxy-2'-fluoro nucleoside"
  modified_base 1,3,5,7,8,9,10,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 823 - DNA, 26 bp, artificial sequence
  LPA RNAi agent antisense strand
  modified_base 2,4,6,8,14,20,22: /mod_base = "2'-deoxy-2'-fluoro nucleoside"
  modified_base 1,3,5,7,9,10,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugagaaugagccucgauaacucuuau

SEQ ID NO: 824 - DNA, 26 bp, artificial sequence
  LPA RNAi agent antisense strand
  modified_base 4,6,10,14,16,18,20,22: /mod_base = "2'-deoxy-2'-fluoro nucleoside"
  modified_base 1,2,3,5,7,8,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 825 - DNA, 26 bp, artificial sequence
  LPA RNAi agent antisense strand
  modified_base 4,6,8,14,16,18,20,22: /mod_base = "2'-deoxy-2'-fluoro nucleoside"
  modified_base 1,2,3,5,7,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 826 - DNA, 26 bp, artificial sequence
  LPA RNAi agent antisense strand
  modified_base 4,6,14,16,18,20,22: /mod_base = "2'-deoxy-2'-fluoro nucleoside"
  modified_base 2,3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 827 - DNA, 26 bp, artificial sequence
  LPA RNAi agent antisense strand
  modified_base 2,4,6,10,14,18,20,22: /mod_base = "2'-deoxy-2'-fluoro nucleoside"
  modified_base 3,5,7,8,9,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 828 - DNA, 26 bp, artificial sequence
  LPA RNAi agent antisense strand
  modified_base 2,4,6,8,14,18,20,22: /mod_base = "2'-deoxy-2'-fluoro nucleoside"
  modified_base 3,5,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 829 - DNA, 26 bp, artificial sequence
  LPA RNAi agent antisense strand
  modified_base 2,4,6,8,14,16,20,22: /mod_base = "2'-deoxy-2'-fluoro nucleoside"
  modified_base 3,5,7,9,10,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 830 - DNA, 26 bp, artificial sequence
  LPA RNAi agent antisense strand
  modified_base 2,4,6,8,10,14,20,22: /mod_base = "2'-deoxy-2'-fluoro nucleoside"
  modified_base 3,5,7,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 831 - DNA, 26 bp, artificial sequence
  LPA RNAi agent antisense strand
  modified_base 2,4,6,8,10,14,18,22: /mod_base = "2'-deoxy-2'-fluoro nucleoside"
  modified_base 3,5,7,9,11,12,13,15,16,17,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 832 - DNA, 26 bp, artificial sequence
  LPA RNAi agent antisense strand
  modified_base 2,4,6,8,10,14,16,22: /mod_base = "2'-deoxy-2'-fluoro nucleoside"
  modified_base 3,5,7,9,11,12,13,15,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 833 - DNA, 26 bp, artificial sequence
  LPA RNAi agent antisense strand
  modified_base 2,4,6,8,10,14,22: /mod_base = "2'-deoxy-2'-fluoro nucleoside"
  modified_base 3,5,7,9,11,12,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 834 - DNA, 26 bp, artificial sequence
  LPA RNAi agent antisense strand
  modified_base 2,4,6,8,10,14,20: /mod_base = "2'-deoxy-2'-fluoro nucleoside"
  modified_base 3,5,7,9,11,12,13,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 835 - DNA, 26 bp, artificial sequence
  LPA RNAi agent antisense strand
  modified_base 2,4,6,8,10,14,18: /mod_base = "2'-deoxy-2'-fluoro nucleoside"
  modified_base 3,5,7,9,11,12,13,15,16,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 836 - DNA, 26 bp, artificial sequence
  LPA RNAi agent antisense strand
  modified_base 4,6,10,14,16,18,20,22: /mod_base = "2'-deoxy-2'-fluoro nucleoside"
  modified_base 2,3,5,7,8,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 837 - DNA, 26 bp, artificial sequence
  LPA RNAi agent antisense strand
  modified_base 4,6,8,14,16,18,20,22: /mod_base = "2'-deoxy-2'-fluoro nucleoside"
  modified_base 2,3,5,7,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 838 - DNA, 26 bp, artificial sequence
  LPA RNAi agent antisense strand
  modified_base 4,6,14,16,18,20,22: /mod_base = "2'-deoxy-2'-fluoro nucleoside"
  modified_base 1,2,3,5,7,8,9,10,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 839 - DNA, 26 bp, artificial sequence
  LPA RNAi agent antisense strand
  modified_base 2,4,6,10,14,18,20,22: /mod_base = "2'-deoxy-2'-fluoro nucleoside"
  modified_base 1,3,5,7,8,9,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 840 - DNA, 26 bp, artificial sequence
  LPA RNAi agent antisense strand
  modified_base 2,4,6,8,14,18,20,22: /mod_base = "2'-deoxy-2'-fluoro nucleoside"
  modified_base 1,3,5,7,9,10,11,12,13,15,16,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 841 - DNA, 26 bp, artificial sequence
  LPA RNAi agent antisense strand
  modified_base 2,4,6,8,14,16,20,22: /mod_base = "2'-deoxy-2'-fluoro nucleoside"
  modified_base 1,3,5,7,9,10,11,12,13,15,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 842 - DNA, 26 bp, artificial sequence
  LPA RNAi agent antisense strand
  modified_base 2,4,6,8,10,14,20,22: /mod_base = "2'-deoxy-2'-fluoro nucleoside"
  modified_base 1,3,5,7,9,11,12,13,15,16,17,18,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 843 - DNA, 26 bp, artificial sequence
  LPA RNAi agent antisense strand
  modified_base 2,4,6,8,10,14,18,22: /mod_base = "2'-deoxy-2'-fluoro nucleoside"
  modified_base 1,3,5,7,9,11,12,13,15,16,17,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 844 - DNA, 26 bp, artificial sequence
  LPA RNAi agent antisense strand
  modified_base 2,4,6,8,10,14,16,22: /mod_base = "2'-deoxy-2'-fluoro nucleoside"
  modified_base 1,3,5,7,9,11,12,13,15,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 845 - DNA, 26 bp, artificial sequence
  LPA RNAi agent antisense strand
  modified_base 2,4,6,8,10,14,22: /mod_base = "2'-deoxy-2'-fluoro nucleoside"
  modified_base 1,3,5,7,9,11,12,13,15,16,17,18,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 846 - DNA, 26 bp, artificial sequence
  LPA RNAi agent antisense strand
  modified_base 2,4,6,8,10,14,20: /mod_base = "2'-deoxy-2'-fluoro nucleoside"
  modified_base 1,3,5,7,9,11,12,13,15,16,17,18,19,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 847 - DNA, 26 bp, artificial sequence
  LPA RNAi agent antisense strand
  modified_base 2,4,6,8,10,14,18: /mod_base = "2'-deoxy-2'-fluoro nucleoside"
  modified_base 1,3,5,7,9,11,12,13,15,16,17,19,20,21,22,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ugacaccugauucuguuucugaguau

SEQ ID NO: 848 - DNA, 26 bp, artificial sequence
  LPA RNAi agent antisense strand
  modified_base 2,8,10,14,16,18,20,22: /mod_base = "2'-deoxy-2'-fluoro nucleoside"
  modified_base 3,4,5,6,7,9,11,12,13,15,17,19,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
tgacaccugauucuguuucugaguau

SEQ ID NO: 849 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acgcagaagggacugccgat

SEQ ID NO: 850 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ggggugcaggagugcuacat

SEQ ID NO: 851 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cuguggcagccccuuauuat

SEQ ID NO: 852 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ggcagccccuuauuguuaat

SEQ ID NO: 853 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
agccccuuauuguuauacat

SEQ ID NO: 854 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gccccuuauuguuauacgat

SEQ ID NO: 855 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ugacacaaugcucagacgat

SEQ ID NO: 856 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gacacaaugcucagacgcat

SEQ ID NO: 857 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acacaaugcucagacgcaat

SEQ ID NO: 858 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acaaugcucagacgcagaat

SEQ ID NO: 859 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cugccgaaauccagauccat

SEQ ID NO: 860 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gccgaaauccagauccugat

SEQ ID NO: 861 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ugacacgaugcucagaugat

SEQ ID NO: 862 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gacacgaugcucagaugcat

SEQ ID NO: 863 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acacgaugcucagaugcaat

SEQ ID NO: 864 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acgaugcucagaugcagaat

SEQ ID NO: 865 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uccaagccuagaggcuuuat

SEQ ID NO: 866 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aggaaacccccgggguacat

SEQ ID NO: 867 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ggaaacccccgggguacaat

SEQ ID NO: 868 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gaaacccccgggguacagat

SEQ ID NO: 869 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ugcuacuaccauuauggaat

SEQ ID NO: 870 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gcuacuaccauuauggacat

SEQ ID NO: 871 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cuaccauuauggacagagat

SEQ ID NO: 872 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
accacaccagcauagucgat

SEQ ID NO: 873 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccacaccagcauagucggat

SEQ ID NO: 874 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cacaccagcauagucggaat

SEQ ID NO: 875 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
caccagcauagucggaccat

SEQ ID NO: 876 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auagucggaccccagaaaat

SEQ ID NO: 877 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uagucggaccccagaaaaat

SEQ ID NO: 878 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccagaugcugagauucgcat

SEQ ID NO: 879 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gcugagauucgcccuuggat

SEQ ID NO: 880 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cugagauucgcccuugguat

SEQ ID NO: 881 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ugagauucgcccuuggugat

SEQ ID NO: 882 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gagauucgcccuugguguat

SEQ ID NO: 883 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auggaucccagugucaggat

SEQ ID NO: 884 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gaaucaaguguccuugcaat

SEQ ID NO: 885 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aaucaaguguccuugcaaat

SEQ ID NO: 886 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gaagcaccaacggagcaaat

SEQ ID NO: 887 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gaguuaucgaggcucauuat

SEQ ID NO: 888 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aguuaucgaggcucauucat

SEQ ID NO: 889 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gacaacagaauauuauccat

SEQ ID NO: 890 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cuugguguuauaccauggat

SEQ ID NO: 891 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gguguuauaccauggaucat

SEQ ID NO: 892 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uauaccauggaucccaauat

SEQ ID NO: 893 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auaccauggaucccaaugat

SEQ ID NO: 894 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uaccauggaucccaauguat

SEQ ID NO: 895 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
accauggaucccaaugucat

SEQ ID NO: 896 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gcaaccugacacaaugucat

SEQ ID NO: 897 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cugacacaauguccagugat

SEQ ID NO: 898 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccagugacagaaucaaguat

SEQ ID NO: 899 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uuaucgaggcucauucucat

SEQ ID NO: 900 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
agaauacuacccaaauggat

SEQ ID NO: 901 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aauacuacccaaauggugat

SEQ ID NO: 902 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auacuacccaaaugguggat

SEQ ID NO: 903 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auucgcccuugguguuauat

SEQ ID NO: 904 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uauaccauggaucccaguat

SEQ ID NO: 905 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
auaccauggaucccagugat

SEQ ID NO: 906 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cacaacucccacggugguat

SEQ ID NO: 907 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aagaacaugucagucuugat

SEQ ID NO: 908 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aguguccucacaacucccat

SEQ ID NO: 909 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aacaagcaccaccugagaat

SEQ ID NO: 910 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccugagaaaagcccugugat

SEQ ID NO: 911 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ugauaccacacuggcaucat

SEQ ID NO: 912 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gauaccacacuggcaucaat

SEQ ID NO: 913 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
gaaacagaaucaggugucat

SEQ ID NO: 914 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
aaacagaaucagguguccat

SEQ ID NO: 915 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cagaaucagguguccuagat

SEQ ID NO: 916 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccuguggcagccccuuauat

SEQ ID NO: 917 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uggcagccccuuauuguuat

SEQ ID NO: 918 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
acaccagcauagucggacat

SEQ ID NO: 919 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ggaauccagaugcugagaat

SEQ ID NO: 920 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uccagaugcugagauucgat

SEQ ID NO: 921 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
augcugagauucgcccuuat

SEQ ID NO: 922 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ccauggaucccagugucaat

SEQ ID NO: 923 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cugaagaagcaccaacggat

SEQ ID NO: 924 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
uccagugacagaaucaagat

SEQ ID NO: 925 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
cucacaacucccacggugat

SEQ ID NO: 926 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
agaaucagguguccuagaat

SEQ ID NO: 927 - DNA, 20 bp, artificial sequence
  LPA RNAi agent sense strand
  modified_base 1,3,5,7,9,11,13,15,17,19: /mod_base = "2'-deoxy-2'-fluoro nucleoside"
  modified_base 2,4,6,8,10,12,14,16,18: /mod_base = "2'-O-methyl nucleoside"
  modified_base 20: /mod_base = "inverted nucleoside"
ucagguguccuagagacuat

SEQ ID NO: 928 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG)modification"
uauagccccuuauuguuauacat

SEQ ID NO: 929 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uaugccccuuauuguuauacgat

SEQ ID NO: 930 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uaugacacaaugcucagacgcat

SEQ ID NO: 931 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauacacaaugcucagacgcaat

SEQ ID NO: 932 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauuuaucgaggcucauucucat

SEQ ID NO: 933 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uaugaaacagaaucaggugucat

SEQ ID NO: 934 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauacaccagcauagucggacat

SEQ ID NO: 935 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauuccagaugcugagauucgat

SEQ ID NO: 936 - DNA, 23 bp, artificial sequence
  LPA RNAi agent sense strand
  modified_base 4,6,8,10,12,14,16,18,20,22: /mod_base = "2'-deoxy-2'-fluoro nucleoside"
  modified_base 1,3,5,7,9,11,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauaugcugagauucgcccuuat

SEQ ID NO: 937 - DNA, 23 bp, artificial sequence
  LPA RNAi agent sense strand
  modified_base 4,6,8,10,11,12,14,16,18,20,22: /mod_base = "2'-deoxy-2'-fluoro nucleoside"
  modified_base 1,3,5,7,9,13,15,17,19,21: /mod_base = "2'-O-methyl nucleoside"
  modified_base 23: /mod_base = "inverted nucleoside"
  modified_base 2: /mod_base = "2'-hydroxy nucleoside"
  modified_base 1: /mod_base = "5' end (Chol-TEG) modification"
uauccauggaucccagugucaat

SEQ ID NO: 938 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uguggcagccccuuauugat

SEQ ID NO: 939 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
cacaaugcucagacgcagat

SEQ ID NO: 940 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
ccgaaauccagauccuguat

SEQ ID NO: 941 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
gacugaggaaacccccggat

SEQ ID NO: 942 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
cuacuaccauuauggacaat

SEQ ID NO: 943 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
acuaccauuauggacagaat

SEQ ID NO: 944 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uaccauuauggacagaguat

SEQ ID NO: 945 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
accauuauggacagaguuat

SEQ ID NO: 946 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
agaugcugagauucgcccat

SEQ ID NO: 947 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
gaugcugagauucgcccuat

SEQ ID NO: 948 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
agauucgcccuugguguuat

SEQ ID NO: 949 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
gacagaaucaaguguccuat

SEQ ID NO: 950 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
acaugucagucuugguccat

SEQ ID NO: 951 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
ccaaaugguggccugaccat

SEQ ID NO: 952 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
ugguguuauaccauggauat

SEQ ID NO: 953 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uguuauaccauggaucccat

SEQ ID NO: 954 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
aaccugacacaauguccaat

SEQ ID NO: 955 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
aauguccagugacagaauat

SEQ ID NO: 956 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uguuucugaacaagcaccat

SEQ ID NO: 957 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uaucgaggcucauucuccat

SEQ ID NO: 958 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
ucgaggcucauucuccacat

SEQ ID NO: 959 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
uccucacaacucccacggat

SEQ ID NO: 960 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
caacucccacggugguccat

SEQ ID NO: 961 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
gcuccuucugaacaagcaat

SEQ ID NO: 962 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
auaccacacuggcaucagat

SEQ ID NO: 963 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
acagaaucagguguccuaat

SEQ ID NO: 964 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
gaaucagguguccuagagat

SEQ ID NO: 965 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
aaucagguguccuagagaat

SEQ ID NO: 966 - DNA, 20 bp, artificial sequence
  LPA RNAi agent sense strand
  modified_base 1,3,5,7,8,9,11,13,15,17,19: /mod_base = "2'-deoxy-2'-fluoro nucleoside"
  modified_base 2,4,6,10,12,14,16,18: /mod_base = "2'-O-methyl nucleoside"
  modified_base 20: /mod_base = "inverted nucleoside"
aucagguguccuagagacat

SEQ ID NO: 967 - DNA, 26 bp, artificial sequence
  LPA RNAi agent sense strand
  modified_base 6,8,10,12,14,16,18,20,22,24,26: /mod_base = "2'-deoxy-2'-fluoro nucleoside"
  modified_base 1,3,5,7,9,11,13,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauauaguuaucgaggcucauucuca

SEQ ID NO: 968 - DNA, 26 bp, artificial sequence
  LPA RNAi agent sense strand
  modified_base 6,8,10,12,15,16,18,20,22,24,26: /mod_base = "2'-deoxy-2'-fluoro nucleoside"
  modified_base 1,3,5,7,9,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauauaguuaucgaggcucauucuca

SEQ ID NO: 969 - DNA, 26 bp, artificial sequence
  LPA RNAi agent sense strand
  modified_base 6,8,10,12,13,15,16,18,20,22,24,26: /mod_base = "2'-deoxy-2'-fluoro nucleoside"
  modified_base 1,3,5,7,9,11,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauauaguuaucgaggcucauucuca

SEQ ID NO: 970 - DNA, 26 bp, artificial sequence
  LPA RNAi agent sense strand
  modified_base 7,9,11,13,15,16,18,20,22,24,26: /mod_base = "2'-deoxy-2'-fluoro nucleoside"
  modified_base 1,3,5,6,8,10,12,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauauaguuaucgaggcucauucuca

SEQ ID NO: 971 - DNA, 26 bp, artificial sequence
  LPA RNAi agent sense strand
  modified_base 6,8,10,12,14,16,18,20,22,24,26: /mod_base = "2'-deoxy-2'-fluoro nucleoside"
  modified_base 1,3,5,7,9,11,13,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauaucagaaacagaaucagguguca

SEQ ID NO: 972 - DNA, 26 bp, artificial sequence
  LPA RNAi agent sense strand
  modified_base 6,8,10,12,15,16,18,20,22,24,26: /mod_base = "2'-deoxy-2'-fluoro nucleoside"
  modified_base 1,3,5,7,9,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauaucagaaacagaaucagguguca

SEQ ID NO: 973 - DNA, 26 bp, artificial sequence
  LPA RNAi agent sense strand
  modified_base 6,8,10,12,13,15,16,18,20,22,24,26: /mod_base = "2'-deoxy-2'-fluoro nucleoside"
  modified_base 1,3,5,7,9,11,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauaucagaaacagaaucagguguca

SEQ ID NO: 974 - DNA, 26 bp, artificial sequence
  LPA RNAi agent sense strand
  modified_base 7,9,11,13,15,16,18,20,22,24,26: /mod_base = "2'-deoxy-2'-fluoro nucleoside"
  modified_base 1,3,5,6,8,10,12,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-SS-Alk-Me) modification"
uauaucagaaacagaaucagguguca

SEQ ID NO: 975 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 976 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucugacacaaugcucagacgca

SEQ ID NO: 977 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauugacacaaugcucagacgcaa

SEQ ID NO: 978 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 979 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 980 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauagaugcugagauucgcccuua

SEQ ID NO: 981 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
gcagccccuuauuguuaa

SEQ ID NO: 982 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
gccccuuauuguuauaca

SEQ ID NO: 983 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
ccccuuauuguuauacga

SEQ ID NO: 984 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
acacaaugcucagacgca

SEQ ID NO: 985 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
cacaaugcucagacgcaa

SEQ ID NO: 986 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
ccgaaauccagauccuga

SEQ ID NO: 987 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
cacgaugcucagaugcaa

SEQ ID NO: 988 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
ccacaccagcauagucga

SEQ ID NO: 989 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
uagucggaccccagaaaa

SEQ ID NO: 990 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
cagaugcugagauucgca

SEQ ID NO: 991 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
aaucaaguguccuugcaa

SEQ ID NO: 992 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
aguuaucgaggcucauua

SEQ ID NO: 993 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
guuaucgaggcucauuca

SEQ ID NO: 994 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
caaccugacacaauguca

SEQ ID NO: 995 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
uaucgaggcucauucuca

SEQ ID NO: 996 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
gaauacuacccaaaugga

SEQ ID NO: 997 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
auacuacccaaaugguga

SEQ ID NO: 998 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
aaacagaaucagguguca

SEQ ID NO: 999 - DNA, 18 bp, artificial sequence
  LPA RNAi agent sense strand
  modified_base 2,4,6,8,10,12,14,16: /mod_base = "2'-deoxy-2'-fluoro nucleoside"
  modified_base 1,3,5,7,9,11,13,15,17: /mod_base = "2'-O-methyl nucleoside"
  modified_base 18: /mod_base = "inverted nucleoside"
  modified_base 2,3: /mod_base = "phosphorothioate linked nucleoside"
aacagaaucaggugucca

SEQ ID NO: 1000 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
cagccccuuauuguuaa

SEQ ID NO: 1001 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
ccccuuauuguuauaca

SEQ ID NO: 1002 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
cccuuauuguuauacga

SEQ ID NO: 1003 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
cacaaugcucagacgca

SEQ ID NO: 1004 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
acaaugcucagacgcaa

SEQ ID NO: 1005 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
cgaaauccagauccuga

SEQ ID NO: 1006 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
acgaugcucagaugcaa

SEQ ID NO: 1007 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
cacaccagcauagucga

SEQ ID NO: 1008 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
agucggaccccagaaaa

SEQ ID NO: 1009 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
agaugcugagauucgca

SEQ ID NO: 1010 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
aucaaguguccuugcaa

SEQ ID NO: 1011 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
guuaucgaggcucauua

SEQ ID NO: 1012 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
uuaucgaggcucauuca

SEQ ID NO: 1013 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
aaccugacacaauguca

SEQ ID NO: 1014 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
aucgaggcucauucuca

SEQ ID NO: 1015 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
aauacuacccaaaugga

SEQ ID NO: 1016 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
uacuacccaaaugguga

SEQ ID NO: 1017 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
aacagaaucagguguca

SEQ ID NO: 1018 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16: /mod_base = "2'-O-methyl nucleoside"
  modified_base 17: /mod_base = "inverted nucleoside"
  modified_base 2,3: /mod_base = "phosphorothioate linked nucleoside"
acagaaucaggugucca

SEQ ID NO: 1019 - DNA, 26 bp, artificial sequence
  LPA RNAi agent sense strand
  modified_base 6,8,12,14,15,16,18,20,22,24,26: /mod_base = "2'-deoxy-2'-fluoro nucleoside"
  modified_base 1,3,5,7,9,10,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1020 - DNA, 26 bp, artificial sequence
  LPA RNAi agent sense strand
  modified_base 14,16: /mod_base = "2'-deoxy-2'-fluoro nucleoside"
  modified_base 1,3,5,6,7,8,9,10,11,12,13,15,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1021 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1022 - DNA, 26 bp, artificial sequence
  LPA RNAi agent sense strand
  modified_base 12,15,16,18: /mod_base = "2'-deoxy-2'-fluoro nucleoside"
  modified_base 1,3,5,6,7,8,9,10,11,13,14,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1023 - DNA, 26 bp, artificial sequence
  LPA RNAi agent sense strand
  modified_base 12,14,16,18: /mod_base = "2'-deoxy-2'-fluoro nucleoside"
  modified_base 1,3,5,6,7,8,9,10,11,13,15,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1024 - DNA, 26 bp, artificial sequence
  LPA RNAi agent sense strand
  modified_base 14,16: /mod_base = "2'-deoxy-2'-fluoro nucleoside"
  modified_base 1,3,5,6,7,8,9,10,11,12,13,15,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1025 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1026 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 1: /mod_base = "5' end (Stearyl) modification"
  modified_base 26: /mod_base = "3' end (C11-PEG3-NAG3) modification"
uauaucagaaacagaaucagguguca

SEQ ID NO: 1027 - DNA, 26 bp, artificial sequence
  LPA RNAi agent sense strand
  modified_base 6,10,12,14,15,16,18,20,22,24,26: /mod_base = "2'-deoxy-2'-fluoro nucleoside"
  modified_base 1,3,5,7,8,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1028 - DNA, 26 bp, artificial sequence
  LPA RNAi agent sense strand
  modified_base 6,12,14,15,16,18,20,22,24,26: /mod_base = "2'-deoxy-2'-fluoro nucleoside"
  modified_base 1,3,5,7,8,9,10,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1029 - DNA, 26 bp, artificial sequence
  LPA RNAi agent sense strand
  modified_base 6,12,16,18,22,24,26: /mod_base = "2'-deoxy-2'-fluoro nucleoside"
  modified_base 1,3,5,7,8,9,10,11,13,14,15,17,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1030 - DNA, 26 bp, artificial sequence
  LPA RNAi agent sense strand
  modified_base 6,8,10,12,14,15,16,18,21,23,26: /mod_base = "2'-deoxy-2'-fluoro nucleoside"
  modified_base 1,3,5,7,9,11,13,17,19,20,22,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1031 - DNA, 26 bp, artificial sequence
  LPA RNAi agent sense strand
  modified_base 6,8,10,12,14,15,16: /mod_base = "2'-deoxy-2'-fluoro nucleoside"
  modified_base 1,3,5,7,9,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1032 - DNA, 26 bp, artificial sequence
  LPA RNAi agent sense strand
  modified_base 6,8,10,12,14,15,16,18,24: /mod_base = "2'-deoxy-2'-fluoro nucleoside"
  modified_base 1,3,5,7,9,11,13,17,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1033 - DNA, 26 bp, artificial sequence
  LPA RNAi agent sense strand
  modified_base 6,8,10,12,14,15,16,18: /mod_base = "2'-deoxy-2'-fluoro nucleoside"
  modified_base 1,3,5,7,9,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1034 - DNA, 26 bp, artificial sequence
  LPA RNAi agent sense strand
  modified_base 6,12,14,15,16,18,24: /mod_base = "2'-deoxy-2'-fluoro nucleoside"
  modified_base 1,3,5,7,8,9,10,11,13,17,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1035 - DNA, 26 bp, artificial sequence
  LPA RNAi agent sense strand
  modified_base 6,8,10,12,14,16,18,20,26: /mod_base = "2'-deoxy-2'-fluoro nucleoside"
  modified_base 1,3,5,7,9,11,13,15,17,19,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagaaacagaaucagguguca

SEQ ID NO: 1036 - DNA, 26 bp, artificial sequence
  LPA RNAi agent sense strand
  modified_base 6,8,10,12,14,15,16,18,20,22,24: /mod_base = "2'-deoxy-2'-fluoro nucleoside"
  modified_base 1,3,5,7,9,11,13,17,19,21,23: /mod_base = "2'-O-methyl nucleoside"
  modified_base 25,26: /mod_base = "2'-MOE nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1037 - DNA, 26 bp, artificial sequence
  LPA RNAi agent sense strand
  modified_base 5: /mod_base = "2'-3' seco nucleoside"
  modified_base 6,8,10,12,14,15,16,18,20,22,24,26: /mod_base = "2'-deoxy-2'-fluoro nucleoside"
  modified_base 1,3,7,9,11,13,17,19,21,23,25: /mod_base = "2'-O-methyl nucleoside"
  modified_base 2,4: /mod_base = "2'-hydroxy nucleoside"
  modified_base 7,8: /mod_base = "phosphorothioate linked nucleoside"
  modified_base 26: /mod_base = "3' end (C11-PEG3-NAG3) modification"
uauauaguuaucgaggcucauucuca

SEQ ID NO: 1038 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 7,8: /mod_base = "phosphorothioate linked nucleoside"
  modified_base 26: /mod_base = "3' end (C11-PEG3-NAG3) modification"
uauauaguuaucgaggcucauucuca

SEQ ID NO: 1039 - DNA, 26 bp, artificial sequence
  LPA RNAi agent sense strand
  modified_base 6,8,10,12,14,15,16,18,20,22,24: /mod_base = "2'-deoxy-2'-fluoro nucleoside"
  modified_base 1,3,5,7,9,11,13,17,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1040 - DNA, 26 bp, artificial sequence
  LPA RNAi agent sense strand
  modified_base 8,10,12,14,15,16,18,20,22,24,26: /mod_base = "2'-deoxy-2'-fluoro nucleoside"
  modified_base 1,3,5,6,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1041 - DNA, 26 bp, artificial sequence
  LPA RNAi agent sense strand
  modified_base 8,10,12,14,15,16,18,20,22,24: /mod_base = "2'-deoxy-2'-fluoro nucleoside"
  modified_base 1,3,5,6,7,9,11,13,17,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1042 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C6-PEG4-NAG3) modification"
uauauaguuaucgaggcucauucuca

SEQ ID NO: 1043 - DNA, 26 bp, artificial sequence
  LPA RNAi agent sense strand
  modified_base 6,8,10,12,14,15,16,18: /mod_base = "2'-deoxy-2'-fluoro nucleoside"
  modified_base 1,3,5,7,9,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1044 - DNA, 26 bp, artificial sequence
  LPA RNAi agent sense strand
  modified_base 6,8,10,12,14,15,16: /mod_base = "2'-deoxy-2'-fluoro nucleoside"
  modified_base 1,3,5,7,9,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1045 - DNA, 26 bp, artificial sequence
  LPA RNAi agent sense strand
  modified_base 6,12,14,15,16,18: /mod_base = "2'-deoxy-2'-fluoro nucleoside"
  modified_base 1,3,5,7,8,9,10,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1046 - DNA, 26 bp, artificial sequence
  LPA RNAi agent sense strand
  modified_base 6,12,14,15,16: /mod_base = "2'-deoxy-2'-fluoro nucleoside"
  modified_base 1,3,5,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1047 - DNA, 26 bp, artificial sequence
  LPA RNAi agent sense strand
  modified_base 12,14,15,16: /mod_base = "2'-deoxy-2'-fluoro nucleoside"
  modified_base 1,3,5,6,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1048 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1049 - DNA, 26 bp, artificial sequence
  LPA RNAi agent sense strand
  modified_base 6,8,10,12,14,15,18: /mod_base = "2'-deoxy-2'-fluoro nucleoside"
  modified_base 1,3,5,7,9,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1050 - DNA, 26 bp, artificial sequence
  LPA RNAi agent sense strand
  modified_base 6,8,10,12,14,15: /mod_base = "2'-deoxy-2'-fluoro nucleoside"
  modified_base 1,3,5,7,9,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1051 - DNA, 26 bp, artificial sequence
  LPA RNAi agent sense strand
  modified_base 6,12,14,15,18: /mod_base = "2'-deoxy-2'-fluoro nucleoside"
  modified_base 1,3,5,7,8,9,10,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1052 - DNA, 26 bp, artificial sequence
  LPA RNAi agent sense strand
  modified_base 6,12,14,15: /mod_base = "2'-deoxy-2'-fluoro nucleoside"
  modified_base 1,3,5,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1053 - DNA, 26 bp, artificial sequence
  LPA RNAi agent sense strand
  modified_base 12,14,15: /mod_base = "2'-deoxy-2'-fluoro nucleoside"
  modified_base 1,3,5,6,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1054 - DNA, 26 bp, artificial sequence
  LPA RNAi agent sense strand
  modified_base 14,15: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1055 - DNA, 26 bp, artificial sequence
  LPA RNAi agent sense strand
  modified_base 6,8,10,12,15,16,18: /mod_base = "2'-deoxy-2'-fluoro nucleoside"
  modified_base 1,3,5,7,9,11,13,14,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1056 - DNA, 26 bp, artificial sequence
  LPA RNAi agent sense strand
  modified_base 6,8,10,12,15,16: /mod_base = "2'-deoxy-2'-fluoro nucleoside"
  modified_base 1,3,5,7,9,11,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1057 - DNA, 26 bp, artificial sequence
  LPA RNAi agent sense strand
  modified_base 6,12,15,16,18: /mod_base = "2'-deoxy-2'-fluoro nucleoside"
  modified_base 1,3,5,7,8,9,10,11,13,14,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1058 - DNA, 26 bp, artificial sequence
  LPA RNAi agent sense strand
  modified_base 6,12,15,16: /mod_base = "2'-deoxy-2'-fluoro nucleoside"
  modified_base 1,3,5,7,8,9,10,11,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1059 - DNA, 26 bp, artificial sequence
  LPA RNAi agent sense strand
  modified_base 12,15,16: /mod_base = "2'-deoxy-2'-fluoro nucleoside"
  modified_base 1,3,5,6,7,8,9,10,11,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1060 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1061 - DNA, 26 bp, artificial sequence
  LPA RNAi agent sense strand
  modified_base 6,8,10,12,14,15,16,18: /mod_base = "2'-deoxy-2'-fluoro nucleoside"
  modified_base 1,3,5,7,9,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1062 - DNA, 26 bp, artificial sequence
  LPA RNAi agent sense strand
  modified_base 6,12,14,15,16,18: /mod_base = "2'-deoxy-2'-fluoro nucleoside"
  modified_base 1,3,5,7,8,9,10,11,13,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1063 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1064 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1065 - DNA, 26 bp, artificial sequence
  LPA RNAi agent sense strand
  modified_base 6,10,12,14,16,20,22,24: /mod_base = "2'-deoxy-2'-fluoro nucleoside"
  modified_base 1,3,5,7,8,9,11,13,15,17,18,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1066 - DNA, 26 bp, artificial sequence
  LPA RNAi agent sense strand
  modified_base 6,10,12,14,16,24: /mod_base = "2'-deoxy-2'-fluoro nucleoside"
  modified_base 1,3,5,7,8,9,11,13,15,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1067 - DNA, 26 bp, artificial sequence
  LPA RNAi agent sense strand
  modified_base 14,16: /mod_base = "2'-deoxy-2'-fluoro nucleoside"
  modified_base 1,3,5,6,7,8,9,10,11,12,13,15,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1068 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1069 - DNA, 26 bp, artificial sequence
  LPA RNAi agent sense strand
  modified_base 6,10,12,14,15,16,20,22,24: /mod_base = "2'-deoxy-2'-fluoro nucleoside"
  modified_base 1,3,5,7,8,9,11,13,17,18,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1070 - DNA, 26 bp, artificial sequence
  LPA RNAi agent sense strand
  modified_base 6,10,12,14,15,16,24: /mod_base = "2'-deoxy-2'-fluoro nucleoside"
  modified_base 1,3,5,7,8,9,11,13,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1071 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1072 - DNA, 26 bp, artificial sequence
  LPA RNAi agent sense strand
  modified_base 6,10,12,15,16,24: /mod_base = "2'-deoxy-2'-fluoro nucleoside"
  modified_base 1,3,5,7,8,9,11,13,14,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1073 - DNA, 26 bp, artificial sequence
  LPA RNAi agent sense strand
  modified_base 14,16: /mod_base = "2'-deoxy-2'-fluoro nucleoside"
  modified_base 1,3,5,6,7,8,9,10,11,12,13,15,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1074 - DNA, 26 bp, artificial sequence
  LPA RNAi agent sense strand
  modified_base 6,10,12,14,16,20,22,24: /mod_base = "2'-deoxy-2'-fluoro nucleoside"
  modified_base 1,3,5,7,8,9,11,13,15,17,18,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1075 - DNA, 26 bp, artificial sequence
  LPA RNAi agent sense strand
  modified_base 6,10,12,14,16,24: /mod_base = "2'-deoxy-2'-fluoro nucleoside"
  modified_base 1,3,5,7,8,9,11,13,15,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1076 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1077 - DNA, 26 bp, artificial sequence
  LPA RNAi agent sense strand
  modified_base 6,10,12,14,15,16,20,22,24: /mod_base = "2'-deoxy-2'-fluoro nucleoside"
  modified_base 1,3,5,7,8,9,11,13,17,18,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1078 - DNA, 26 bp, artificial sequence
  LPA RNAi agent sense strand
  modified_base 6,10,12,14,15,16,24: /mod_base = "2'-deoxy-2'-fluoro nucleoside"
  modified_base 1,3,5,7,8,9,11,13,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1079 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1080 - DNA, 26 bp, artificial sequence
  LPA RNAi agent sense strand
  modified_base 6,10,12,15,16,24: /mod_base = "2'-deoxy-2'-fluoro nucleoside"
  modified_base 1,3,5,7,8,9,11,13,14,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauaucagccccuuauuguuauacga

SEQ ID NO: 1081 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C11-PEG3-NAG3) modification"
uauauaguuaucgaggcucauucuca

SEQ ID NO: 1082 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25: /mod_base = "2'-O-methyl nucleoside"
  modified_base 26: /mod_base = "inverted nucleoside"
  modified_base 2,4: /mod_base = "2'-hydroxy nucleoside"
  modified_base 6,7: /mod_base = "phosphorothioate linked nucleoside"
  modified_base 1: /mod_base = "5' end (Chol-TEG) modification"
uauauaguuaucgaggcucauucuca

SEQ ID NO: 1083 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 1: /mod_base = "5' end (Chol-TEG) modification"
uauauaguuaucgaggcucauucuca

SEQ ID NO: 1084 - DNA, 26 bp, artificial sequence
  LPA RNAi agent sense strand
  modified_base 6,8,10,12,14,15,16,18,20,22,24: /mod_base = "2'-deoxy-2'-fluoro nucleoside"
  modified_base 1,3,5,7,9,11,13,17,19,21,23,25: /mod_base = "2'-O-methyl nucleoside"
  modified_base 26: /mod_base = "inverted nucleoside"
  modified_base 2,4: /mod_base = "2'-hydroxy nucleoside"
  modified_base 6: /mod_base = "phosphorothioate linked nucleoside"
  modified_base 1: /mod_base = "5' end (Chol-TEG) modification"
uauauaguuaucgaggcucauucuca

SEQ ID NO: 1085 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
ccccuuauuguuauaca

SEQ ID NO: 1086 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
cccuuauuguuauacga

SEQ ID NO: 1087 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
agaugcugagauucgca

SEQ ID NO: 1088 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
guuaucgaggcucauua

SEQ ID NO: 1089 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
aucgaggcucauucuca

SEQ ID NO: 1090 - DNA, 17 bp, artificial sequence
  LPA RNAi agent sense strand
  modified_base 1,3,5,7,9,11,13,15: /mod_base = "2'-deoxy-2'-fluoro nucleoside"
  modified_base 2,4,6,8,10,12,14,16,17: /mod_base = "2'-O-methyl nucleoside"
  modified_base 2,3: /mod_base = "phosphorothioate linked nucleoside"
  modified_base 17: /mod_base = "3' end (NAG13) modification"
aacagaaucagguguca

SEQ ID NO: 1091 - DNA, 26 bp, artificial sequence
  LPA RNAi agent sense strand
  modified_base 15,16: /mod_base = "2'-deoxy-2'-fluoro nucleoside"
  modified_base 1,3,5,6,7,8,9,10,11,12,13,14,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauauaguuaucgaggcucauucuca

SEQ ID NO: 1092 - DNA, 26 bp, artificial sequence
  LPA RNAi agent sense strand
  modified_base 6,8,10,12,14,15,16,18,20,22,24: /mod_base = "2'-deoxy-2'-fluoro nucleoside"
  modified_base 1,3,5,7,9,11,13,17,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1093 - DNA, 26 bp, artificial sequence
  LPA RNAi agent sense strand
  modified_base 12,14,16: /mod_base = "2'-deoxy-2'-fluoro nucleoside"
  modified_base 1,3,5,6,7,8,9,10,11,13,15,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1094 - DNA, 26 bp, artificial sequence
  LPA RNAi agent sense strand
  modified_base 15,16,18: /mod_base = "2'-deoxy-2'-fluoro nucleoside"
  modified_base 1,3,5,6,7,8,9,10,11,12,13,14,17,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1095 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1096 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (C-SS-Alk-Me) modification"
uauauaguuaucgaggcucauucuca

SEQ ID NO: 1097 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauauaguuaucgaggcucauucuca

SEQ ID NO: 1098 - DNA, 26 bp, artificial sequence
  LPA RNAi agent sense strand
  modified_base 8,10,12,14,15,16,18,20,22,24: /mod_base = "2'-deoxy-2'-fluoro nucleoside"
  modified_base 1,3,5,6,7,9,11,13,17,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1099 - DNA, 26 bp, artificial sequence
  LPA RNAi agent sense strand
  modified_base 14,15,16: /mod_base = "2'-deoxy-2'-fluoro nucleoside"
  modified_base 1,3,5,6,7,8,9,10,11,12,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagcgccuuauuguuauacga

SEQ ID NO: 1100 - DNA, 26 bp, artificial sequence
  LPA RNAi agent sense strand
  modified_base 8,10,12,14,15,16,18,20,22,24: /mod_base = "2'-deoxy-2'-fluoro nucleoside"
  modified_base 1,3,5,6,7,9,11,13,17,19,21,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagccccuuauuguuauacga

SEQ ID NO: 1101 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15,16,17: /mod_base = "2'-O-methyl nucleoside"
  modified_base 2,3: /mod_base = "phosphorothioate linked nucleoside"
  modified_base 17: /mod_base = "3' end (NAG13) modification"
ccccuuauuguuauaca

SEQ ID NO: 1102 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (NAG13) modification"
ccccuuauuguuauaca

SEQ ID NO: 1103 - DNA, 17 bp, artificial sequence
  LPA RNAi agent sense strand
  modified_base 5,6,7: /mod_base = "2'-deoxy-2'-fluoro nucleoside"
  modified_base 3,4,8,9,10,11,12,13,14,15: /mod_base = "2'-O-methyl nucleoside"
  modified_base 1,2,16,17: /mod_base = "2'-MOE nucleoside"
  modified_base 2,3: /mod_base = "phosphorothioate linked nucleoside"
  modified_base 17: /mod_base = "3' end (NAG13) modification"
ccccuuauuguuauaca

SEQ ID NO: 1104 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15,16,17: /mod_base = "2'-O-methyl nucleoside"
  modified_base 2,3: /mod_base = "phosphorothioate linked nucleoside"
  modified_base 17: /mod_base = "3' end (NAG13) modification"
cccuuauuguuauacga

SEQ ID NO: 1105 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (NAG13) modification"
cccuuauuguuauacga

SEQ ID NO: 1106 - DNA, 17 bp, artificial sequence
  LPA RNAi agent sense strand
  modified_base 5,6,7: /mod_base = "2'-deoxy-2'-fluoro nucleoside"
  modified_base 3,4,8,9,10,11,12,13,14,15: /mod_base = "2'-O-methyl nucleoside"
  modified_base 1,2,16,17: /mod_base = "2'-MOE nucleoside"
  modified_base 2,3: /mod_base = "phosphorothioate linked nucleoside"
  modified_base 17: /mod_base = "3' end (NAG13) modification"
cccuuauuguuauacga

SEQ ID NO: 1107 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15,16,17: /mod_base = "2'-O-methyl nucleoside"
  modified_base 2,3: /mod_base = "phosphorothioate linked nucleoside"
  modified_base 17: /mod_base = "3' end (NAG13) modification"
aucgaggcucauucuca

SEQ ID NO: 1108 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (NAG13) modification"
aucgaggcucauucuca

SEQ ID NO: 1109 - DNA, 17 bp, artificial sequence
  LPA RNAi agent sense strand
  modified_base 5,6,7: /mod_base = "2'-deoxy-2'-fluoro nucleoside"
  modified_base 3,4,8,9,10,11,12,13,14,15: /mod_base = "2'-O-methyl nucleoside"
  modified_base 1,2,16,17: /mod_base = "2'-MOE nucleoside"
  modified_base 2,3: /mod_base = "phosphorothioate linked nucleoside"
  modified_base 17: /mod_base = "3' end (NAG13) modification"
atcgaggcucauucuca

SEQ ID NO: 1110 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15,16,17: /mod_base = "2'-O-methyl nucleoside"
  modified_base 2,3: /mod_base = "phosphorothioate linked nucleoside"
  modified_base 17: /mod_base = "3' end (NAG13) modification"
aacagaaucagguguca

SEQ ID NO: 1111 - DNA, 17 bp, artificial sequence
  LPA RNAi agent sense strand
  modified_base 5,6,7: /mod_base = "2'-deoxy-2'-fluoro nucleoside"
  modified_base 1,2,3,4,8,9,10,11,12,13,14,15: /mod_base = "2'-O-methyl nucleoside"
  modified_base 16,17: /mod_base = "2'-MOE nucleoside"
  modified_base 2,3: /mod_base = "phosphorothioate linked nucleoside"
  modified_base 17: /mod_base = "3' end (NAG13) modification"
aacagaaucagguguca

SEQ ID NO: 1112 - DNA, 17 bp, artificial sequence
  LPA RNAi agent sense strand
  modified_base 5,6,7: /mod_base = "2'-deoxy-2'-fluoro nucleoside"
  modified_base 3,4,8,9,10,11,12,13,14,15: /mod_base = "2'-O-methyl nucleoside"
  modified_base 1,2,16,17: /mod_base = "2'-MOE nucleoside"
  modified_base 2,3: /mod_base = "phosphorothioate linked nucleoside"
  modified_base 17: /mod_base = "3' end (NAG13) modification"
aacagaaucagguguca

SEQ ID NO: 1113 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG18) modification"
uauauaguuaucgaggcucauucuca

SEQ ID NO: 1114 - DNA, 26 bp, artificial sequence
  LPA RNAi agent sense strand
  modified_base 8,10,12,14,15,16,18,20,22,24: /mod_base = "2'-deoxy-2'-fluoro nucleoside"
  modified_base 1,2,3,4,5,6,7,9,11,13,17,19,21,23,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG18) modification"
uauaucagccccuuauuguuauacga

SEQ ID NO: 1115 - DNA, 24 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22,23,24: /mod_base = "2'-O-methyl nucleoside"
  modified_base 2,24: /mod_base = "phosphorothioate linked nucleoside"
  modified_base 1: /mod_base = "5' end (NAG4) modification"
ucagccccuuauuguuauacgauu

SEQ ID NO: 1116 - DNA, 22 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22: /mod_base = "2'-O-methyl nucleoside"
  modified_base 2,22: /mod_base = "phosphorothioate linked nucleoside"
  modified_base 1: /mod_base = "5' end (NAG4) modification"
ucagccccuuauuguuauacga

SEQ ID NO: 1117 - DNA, 24 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22,23,24: /mod_base = "2'-O-methyl nucleoside"
  modified_base 2,24: /mod_base = "phosphorothioate linked nucleoside"
  modified_base 1: /mod_base = "5' end (NAG24) modification"
ucagccccuuauuguuauacgauu

SEQ ID NO: 1118 - DNA, 24 bp, artificial sequence
  LPA RNAi agent sense strand
  modified_base 10,11,12: /mod_base = "2'-deoxy-2'-fluoro nucleoside"
  modified_base 1,2,3,4,5,6,7,8,9,13,14,15,16,17,18,19,20,21,22,23,24: /mod_base = "2'-O-methyl nucleoside"
  modified_base 2,24: /mod_base = "phosphorothioate linked nucleoside"
  modified_base 1: /mod_base = "5' end (NAG4) modification"
uaguuaucgaggcucauucucauu

SEQ ID NO: 1119 - DNA, 26 bp, artificial sequence
  LPA RNAi agent sense strand
  modified_base 12,14,15,16: /mod_base = "2'-deoxy-2'-fluoro nucleoside"
  modified_base 1,3,5,6,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauaucagccccuuauuguuauacga

SEQ ID NO: 1120 - DNA, 26 bp, artificial sequence
  LPA RNAi agent sense strand
  modified_base 12,14,15,16: /mod_base = "2'-deoxy-2'-fluoro nucleoside"
  modified_base 1,3,5,6,7,8,9,10,11,13,17,18,19,20,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
  modified_base 26: /mod_base = "3' end (NAG13) modification"
uauauaguuaucgaggcucauucuca

SEQ ID NO: 1121 - DNA, 26 bp, artificial sequence
  LPA RNAi agent sense strand
  modified_base 8,10,12,14,15,16,18,20,22,24: /mod_base = "2'-deoxy-2'-fluoro nucleoside"
  modified_base 1,2,3,4,5,6,7,9,11,13,17,19,21,23,25: /mod_base = "2'-O-methyl nucleoside"
  modified_base 6,26: /mod_base = "phosphorothioate linked nucleoside"
  modified_base 1: /mod_base = "5' end (NAG4) modification"
uauaucagccccuuauuguuauacga

SEQ ID NO: 1122 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
  modified_base 1: /mod_base = "5' end (NAG4) modification"
gccccuuauuguuauacgauu

SEQ ID NO: 1123 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
uauauaguuaucgaggcucauucuca

SEQ ID NO: 1124 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24: /mod_base = "2'-O-methyl nucleoside"
  modified_base 26: /mod_base = "inverted nucleoside"
  modified_base 25: /mod_base = "2'-MOE nucleoside"
  modified_base 6,7: /mod_base = "phosphorothioate linked nucleoside"
  modified_base 1: /mod_base = "5' end (Alk-PEG5-C6) modification"
uauauaguuaucgaggcucauucuca

SEQ ID NO: 1125 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24: /mod_base = "2'-O-methyl nucleoside"
  modified_base 26: /mod_base = "inverted nucleoside"
  modified_base 25: /mod_base = "2'-MOE nucleoside"
  modified_base 6,7: /mod_base = "phosphorothioate linked nucleoside"
  modified_base 1: /mod_base = "5' end (Alk-SMPT-C6) modification"
uauauaguuaucgaggcucauucuca

SEQ ID NO: 1126 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24: /mod_base = "2'-O-methyl nucleoside"
  modified_base 26: /mod_base = "inverted nucleoside"
  modified_base 25: /mod_base = "2'-MOE nucleoside"
  modified_base 6,7: /mod_base = "phosphorothioate linked nucleoside"
  modified_base 1: /mod_base = "5' end (NAG26) modification"
uauauaguuaucgaggcucauucuca

SEQ ID NO: 1127 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24: /mod_base = "2'-O-methyl nucleoside"
  modified_base 26: /mod_base = "inverted nucleoside"
  modified_base 25: /mod_base = "2'-MOE nucleoside"
  modified_base 6,7: /mod_base = "phosphorothioate linked nucleoside"
  modified_base 1: /mod_base = "5' end (NAG27) modification"
uauauaguuaucgaggcucauucuca

SEQ ID NO: 1128 - DNA, 26 bp, artificial sequence
  LPA RNAi agent sense strand
  modified_base 13,14,15: /mod_base = "2'-deoxy-2'-fluoro nucleoside"
  modified_base 1,2,3,4,5,6,7,8,9,10,11,12,16,17,18,19,20,21,22,23,24,25: /mod_base = "2'-O-methyl nucleoside"
  modified_base 26: /mod_base = "inverted nucleoside"
  modified_base 5,6: /mod_base = "phosphorothioate linked nucleoside"
  modified_base 1: /mod_base = "5' end (NAG25) modification"
auaucagccccuuauuguuauacgat

SEQ ID NO: 1129 - DNA, 26 bp, artificial sequence
  LPA RNAi agent sense strand
  modified_base 12,13,14: /mod_base = "2'-deoxy-2'-fluoro nucleoside"
  modified_base 1,2,3,4,5,6,7,8,9,10,11,15,16,17,18,19,20,21,22,23,24,25: /mod_base = "2'-O-methyl nucleoside"
  modified_base 26: /mod_base = "inverted nucleoside"
  modified_base 4,5: /mod_base = "phosphorothioate linked nucleoside"
  modified_base 1: /mod_base = "5' end (NAG25) modification"
uaucagccccuuauuguuauacgaut

SEQ ID NO: 1130 - DNA, 26 bp, artificial sequence
  LPA RNAi agent sense strand
  modified_base 13,14,15: /mod_base = "2'-deoxy-2'-fluoro nucleoside"
  modified_base 1,2,3,4,5,6,7,8,9,10,11,12,16,17,18,19,20,21,22,23,24,25: /mod_base = "2'-O-methyl nucleoside"
  modified_base 26: /mod_base = "inverted nucleoside"
  modified_base 5,6: /mod_base = "phosphorothioate linked nucleoside"
  modified_base 1: /mod_base = "5' end (NAG25) modification"
auauaguuaucgaggcucauucucat

SEQ ID NO: 1131 - DNA, 26 bp, artificial sequence
  LPA RNAi agent sense strand
  modified_base 12,13,14: /mod_base = "2'-deoxy-2'-fluoro nucleoside"
  modified_base 1,2,3,4,5,6,7,8,9,10,11,15,16,17,18,19,20,21,22,23,24,25: /mod_base = "2'-O-methyl nucleoside"
  modified_base 26: /mod_base = "inverted nucleoside"
  modified_base 4,5: /mod_base = "phosphorothioate linked nucleoside"
  modified_base 1: /mod_base = "5' end (NAG25) modification"
uauaguuaucgaggcucauucucaut

SEQ ID NO: 1132 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
uauaucagccccuuauuguuauacga

SEQ ID NO: 1133 - DNA, 21 bp, artificial sequence
  LPA RNAi agent sense strand
  modified_base 7,8,9: /mod_base = "2'-deoxy-2'-fluoro nucleoside"
  modified_base 1,2,3,4,5,6,10,11,12,13,14,15,16,17,18,19,20,21: /mod_base = "2'-O-methyl nucleoside"
gccccuuauuguuauacgauu

SEQ ID NO: 1134 - DNA, 21 bp, artificial sequence
  LPA RNAi agent sense strand
  modified_base 7,8,9: /mod_base = "2'-deoxy-2'-fluoro nucleoside"
  modified_base 1,2,3,4,5,6,10,11,12,13,14,15,16,17,18,19,20,21: /mod_base = "2'-O-methyl nucleoside"
  modified_base 21: /mod_base = "phosphorothioate linked nucleoside"
uuaucgaggcucauucucauu

SEQ ID NO: 1135 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 22: /mod_base = "phosphorothioate linked nucleoside"
gccccuuauuguuauacgauu

SEQ ID NO: 1136 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG29) modification"
uauauaguuaucgaggcucauucuca

SEQ ID NO: 1137 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,9,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1138 - DNA, 26 bp, artificial sequence
  LPA RNAi agent sense strand
  modified_base 15,16: /mod_base = "2'-deoxy-2'-fluoro nucleoside"
  modified_base 1,2,3,4,5,6,7,8,9,10,11,12,13,14,17,18,19,20,21,22,23,24,25,26: /mod_base = "2'-O-methyl nucleoside"
  modified_base 8,26: /mod_base = "phosphorothioate linked nucleoside"
  modified_base 1: /mod_base = "5' end (NAG29) modification"
uauauaauuaucgaggcucauucuca

SEQ ID NO: 1139 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1140 - DNA, 26 bp, artificial sequence
  LPA RNAi agent sense strand
  modified_base 15,16: /mod_base = "2'-deoxy-2'-fluoro nucleoside"
  modified_base 1,2,3,4,5,6,7,8,9,10,11,12,13,14,17,18,19,20,21,22,23,24,25,26: /mod_base = "2'-o-methyl nucleoside"
  modified_base 8,26: /mod_base = "phosphorothioate linked nucleoside"
  modified_base 1: /mod_base = "5' end (NAG25) modification"
uauauaauuaucgaggcucauucuca

SEQ ID NO: 1141 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 7,8: /mod_base = "phosphorothioate linked nucleoside"
  modified_base 1: /mod_base = "5' end (NAG25) modification"
uauaucagccccuuauuguuauacga

SEQ ID NO: 1142 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 8: /mod_base = "phosphorothioate linked nucleoside"
  modified_base 1: /mod_base = "5' end (NAG25) modification"
uauaucagccccuuauuguuauacga

SEQ ID NO: 1143 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 7,8: /mod_base = "phosphorothioate linked nucleoside"
  modified_base 1: /mod_base = "5' end (NAG25) modification"
uauauaguuaucgaggcucauucuca

SEQ ID NO: 1144 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 8: /mod_base = "phosphorothioate linked nucleoside"
  modified_base 1: /mod_base = "5' end (NAG25) modification"
uauauaguuaucgaggcucauucuca

SEQ ID NO: 1145 - DNA, 22 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22: /mod_base = "2'-O-methyl nucleoside"
  modified_base 2,22: /mod_base = "phosphorothioate linked nucleoside"
  modified_base 1: /mod_base = "5' end (NAG30) modification"
ucagccccuuauuguuauacga

SEQ ID NO: 1146 - DNA, 25 bp, artificial sequence
  LPA RNAi agent sense strand
  modified_base 11,12,13: /mod_base = "2'-deoxy-2'-fluoro nucleoside"
  modified_base 1,2,3,4,5,6,7,8,9,10,14,15,16,17,18,19,20,21,22: /mod_base = "2'-O-methyl nucleoside"
  modified_base 24: /mod_base = "inverted nucleoside"
  modified_base 23: /mod_base = "2'-MOE nucleoside"
  modified_base 4,24: /mod_base = "phosphorothioate linked nucleoside"
  modified_base 1: /mod_base = "5' end (NAG25) modification"
ggcagccccuuauuguuauacgatt

SEQ ID NO: 1147 - DNA, 26 bp, artificial sequence
  LPA RNAi agent sense strand
  modified_base 11,12,13: /mod_base = "2'-deoxy-2'-fluoro nucleoside"
  modified_base 1,2,3,4,5,6,7,8,9,10,14,15,16,17,18,19,20,21,22,24,25: /mod_base = "2'-O-methyl nucleoside"
  modified_base 26: /mod_base = "inverted nucleoside"
  modified_base 23: /mod_base = "2'-MOE nucleoside"
  modified_base 4,24: /mod_base = "phosphorothioate linked nucleoside"
  modified_base 1: /mod_base = "5' end (NAG25) modification"
ggcagccccuuauuguuauacgauut

SEQ ID NO: 1148 - DNA, 25 bp, artificial sequence
  LPA RNAi agent sense strand
  modified_base 1: /mod_base = "2'-3' seco nucleoside"
  modified_base 11,12,13: /mod_base = "2'-deoxy-2'-fluoro nucleoside"
  modified_base 2,3,4,5,6,7,8,9,10,14,15,16,17,18,19,20,21,22: /mod_base = "2'-O-methyl nucleoside"
  modified_base 24: /mod_base = "inverted nucleoside"
  modified_base 23: /mod_base = "2'-MOE nucleoside"
  modified_base 4,24: /mod_base = "phosphorothioate linked nucleoside"
  modified_base 1: /mod_base = "5' end (NAG25) modification"
ggcagccccuuauuguuauacgatt

SEQ ID NO: 1149 - DNA, 25 bp, artificial sequence
  LPA RNAi agent sense strand
  modified_base 11,12,13: /mod_base = "2'-deoxy-2'-fluoro nucleoside"
  modified_base 1,2,3,5,6,7,8,9,10,14,15,16,17,18,19,20,21,22: /mod_base = "2'-O-methyl nucleoside"
  modified_base 24: /mod_base = "inverted nucleoside"
  modified_base 23: /mod_base = "2'-MOE nucleoside"
  modified_base 4,24: /mod_base = "phosphorothioate linked nucleoside"
  modified_base 1: /mod_base = "5' end (NAG25) modification"
ggcagccccuuauuguuauacgatt

SEQ ID NO: 1150 - DNA, 25 bp, artificial sequence
  LPA RNAi agent sense strand
  modified_base 9,10,11: /mod_base = "2'-deoxy-2'-fluoro nucleoside"
  modified_base 1,2,3,4,5,6,7,8,12,13,14,15,16,17,18,19,20: /mod_base = "2'-O-methyl nucleoside"
  modified_base 22: /mod_base = "inverted nucleoside"
  modified_base 21: /mod_base = "2'-MOE nucleoside"
  modified_base 2,22: /mod_base = "phosphorothioate linked nucleoside"
  modified_base 1: /mod_base = "5' end (NAG25) modification"
cagccccuuauuguuauacgatttt

SEQ ID NO: 1151 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1152 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1153 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 8,9: /mod_base = "phosphorothioate linked nucleoside"
  modified_base 1: /mod_base = "5' end (NAG25) modification"
uauauaguuaucgaggcucauucuca

SEQ ID NO: 1154 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 9,10: /mod_base = "phosphorothioate linked nucleoside"
  modified_base 1: /mod_base = "5' end (NAG25) modification"
uauauaguuaucgaggcucauucuca

SEQ ID NO: 1155 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
gcgauaguuaucgaggcucauucuca

SEQ ID NO: 1156 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
ugaauaguuaucgaggcucauucuca

SEQ ID NO: 1157 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
aucguaguuaucgaggcucauucuca

SEQ ID NO: 1158 - DNA, 26 bp, artificial sequence
  LPA RNAi agent sense strand
  modified_base 14,15,16: /mod_base = "2'-deoxy-2'-fluoro nucleoside"
  modified_base 1,3,4,5,6,7,8,9,10,11,12,13,17,18,19,20,21,22,23,24,25: /mod_base = "2'-O-methyl nucleoside"
  modified_base 2,26: /mod_base = "inverted nucleoside"
  modified_base 6,7: /mod_base = "phosphorothioate linked nucleoside"
  modified_base 1: /mod_base = "5' end (NAG25) modification"
uauauaguuaucgaggcucauucuca

SEQ ID NO: 1159 - DNA, 26 bp, artificial sequence
  LPA RNAi agent sense strand
  modified_base 14,15,16: /mod_base = "2'-deoxy-2'-fluoro nucleoside"
  modified_base 1,2,3,4,6,7,8,9,10,11,12,13,17,18,19,20,21,22,23,24,25: /mod_base = "2'-O-methyl nucleoside"
  modified_base 5,26: /mod_base = "inverted nucleoside"
  modified_base 6,7: /mod_base = "phosphorothioate linked nucleoside"
  modified_base 1: /mod_base = "5' end (NAG25) modification"
uauaaaguuaucgaggcucauucuca

SEQ ID NO: 1160 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
uauauaguuaucgaggcucauucuca

SEQ ID NO: 1161 - DNA, 20 bp, artificial sequence
  LPA RNAi agent sense strand
  modified_base 2,4,6,8,9,10,12,14,16,18: /mod_base = "2'-deoxy-2'-fluoro nucleoside"
  modified_base 1,3,5,7,11,13,15,17,19,20: /mod_base = "2'-O-methyl nucleoside"
  modified_base 20: /mod_base = "phosphorothioate linked nucleoside"
  modified_base 1: /mod_base = "5' end (NAG30) modification"
agccccuuauuguuauacga

SEQ ID NO: 1162 - DNA, 21 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21: /mod_base = "2'-O-methyl nucleoside"
  modified_base 21: /mod_base = "phosphorothioate linked nucleoside"
  modified_base 1: /mod_base = "5' end (NAG30) modification"
aagccccuuauuguuauacga

SEQ ID NO: 1163 - DNA, 20 bp, artificial sequence
  LPA RNAi agent sense strand
  modified_base 2,4,6,8,9,10,12,14,16,18: /mod_base = "2'-deoxy-2'-fluoro nucleoside"
  modified_base 1,3,5,7,11,13,15,17,19,20: /mod_base = "2'-O-methyl nucleoside"
  modified_base 1,2: /mod_base = "phosphorothioate linked nucleoside"
  modified_base 1: /mod_base = "5' end (NAG30) modification"
agccccuuauuguuauacga

SEQ ID NO: 1164 - DNA, 22 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22: /mod_base = "2'-O-methyl nucleoside"
  modified_base 2,22: /mod_base = "phosphorothioate linked nucleoside"
  modified_base 1: /mod_base = "5' end (NAG30) modification"
gcagccccuuauuguuauacga

SEQ ID NO: 1165 - DNA, 26 bp, artificial sequence
  LPA RNAi agent sense strand
  modified_base 15,16: /mod_base = "2'-deoxy-2'-fluoro nucleoside"
  modified_base 1,2,3,4,5,6,7,8,9,10,11,12,13,14,17,18,19,20,21,22,23,24,25,26: /mod_base = "2'-O-methyl nucleoside"
  modified_base 8,26: /mod_base = "phosphorothioate linked nucleoside"
  modified_base 1: /mod_base = "5' end (NAG25) modification"
uauauaguuaucgaggcucauucuca

SEQ ID NO: 1166 - DNA, 22 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22: /mod_base = "2'-O-methyl nucleoside"
  modified_base 1,2,22: /mod_base = "phosphorothioate linked nucleoside"
  modified_base 1: /mod_base = "5' end (NAG30) modification"
gcagccccuuauuguuauacga

SEQ ID NO: 1167 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1168 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1169 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 21: /mod_base = "phosphorothioate linked nucleoside"
gccccuuauuguuauacgauu

SEQ ID NO: 1170 - DNA, 21 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21: /mod_base = "2'-O-methyl nucleoside"
  modified_base 21: /mod_base = "phosphorothioate linked nucleoside"
  modified_base 1: /mod_base = "5' end (NAG30) modification"
acgccccuuauuguuauacga

SEQ ID NO: 1171 - DNA, 21 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21: /mod_base = "2'-O-methyl nucleoside"
  modified_base 1,2: /mod_base = "phosphorothioate linked nucleoside"
  modified_base 1: /mod_base = "5' end (NAG30) modification"
aagccccuuauuguuauacga

SEQ ID NO: 1172 - DNA, 21 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21: /mod_base = "2'-O-methyl nucleoside"
  modified_base 1,2: /mod_base = "phosphorothioate linked nucleoside"
  modified_base 1: /mod_base = "5' end (NAG30) modification"
acgccccuuauuguuauacga

SEQ ID NO: 1173 - DNA, 22 bp, artificial sequence
  LPA RNAi agent sense strand
  modified_base 4,6,8,10,11,12,14,16,18,20: /mod_base = "2'-deoxy-2'-fluoro nucleoside"
  modified_base 1,2,3,5,7,9,13,15,17,19,21,22: /mod_base = "2'-O-methyl nucleoside"
  modified_base 1,2: /mod_base = "phosphorothioate linked nucleoside"
  modified_base 1: /mod_base = "5' end (NAG30) modification"
gcagccccuuauuguuauacga

SEQ ID NO: 1174 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 1,21: /mod_base = "phosphorothioate linked nucleoside"
  modified_base 1: /mod_base = "5' end (NAG31)s modification"
gccccuuauuguuauacgauu

SEQ ID NO: 1175 - DNA, 22 bp, artificial sequence
  LPA RNAi agent sense strand
  modified_base 2,4,6,8,9,10,12,14,16,18: /mod_base = "2'-deoxy-2'-fluoro nucleoside"
  modified_base 1,3,5,7,11,13,15,17,19,20,21,22: /mod_base = "2'-O-methyl nucleoside"
  modified_base 1,22: /mod_base = "phosphorothioate linked nucleoside"
  modified_base 1: /mod_base = "5' end (NAG31)s modification"
agccccuuauuguuauacgauu

SEQ ID NO: 1176 - DNA, 21 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21: /mod_base = "2'-O-methyl nucleoside"
  modified_base 1,2: /mod_base = "phosphorothioate linked nucleoside"
  modified_base 1: /mod_base = "5' end (NAG31)s modification"
aagccccuuauuguuauacga

SEQ ID NO: 1177 - DNA, 23 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,21,22,23: /mod_base = "2'-O-methyl nucleoside"
  modified_base 1,2,23: /mod_base = "phosphorothioate linked nucleoside"
  modified_base 1: /mod_base = "5' end (NAG31)s modification"
aagccccuuauuguuauacgauu

SEQ ID NO: 1178 - DNA, 23 bp, artificial sequence
  LPA RNAi agent sense strand
  modified_base 3,5,7,9,10,11,13,15,17,19: /mod_base = "2'-deoxy-2'-fluoro nucleoside"
  modified_base 1,2,4,6,8,12,14,16,18,20,22,23: /mod_base = "2'-O-methyl nucleoside"
  modified_base 21: /mod_base = "inverted nucleoside"
  modified_base 1,2,23: /mod_base = "phosphorothioate linked nucleoside"
  modified_base 1: /mod_base = "5' end (NAG31)s modification"
aagccccuuauuguuauacgauu

SEQ ID NO: 1179 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG31) modification"
uauauaguuaucgaggcucauucuca

SEQ ID NO: 1180 - DNA, 24 bp, artificial sequence
  LPA RNAi agent sense strand
  modified_base 12,13,14: /mod_base = "2'-deoxy-2'-fluoro nucleoside"
  modified_base 1,2,3,4,5,6,7,8,9,10,11,15,16,17,18,19,20,21,22,23: /mod_base = "2'-O-methyl nucleoside"
  modified_base 4,5,24: /mod_base = "phosphorothioate linked nucleoside"
  modified_base 1: /mod_base = "5' end (NAG31) modification"
uaucagccccuuauuguuauacga

SEQ ID NO: 1181 - DNA, 24 bp, artificial sequence
  LPA RNAi agent sense strand
  modified_base 12,13,14: /mod_base = "2'-deoxy-2'-fluoro nucleoside"
  modified_base 1,2,3,4,5,6,7,8,9,10,11,15,16,17,18,19,20,21,22,23: /mod_base = "2'-O-methyl nucleoside"
  modified_base 4,5,24: /mod_base = "phosphorothioate linked nucleoside"
  modified_base 1: /mod_base = "5' end (NAG31) modification"
uagcagccccuuauuguuauacga

SEQ ID NO: 1182 - DNA, 24 bp, artificial sequence
  LPA RNAi agent sense strand
  modified_base 12,13,14: /mod_base = "2'-deoxy-2'-fluoro nucleoside"
  modified_base 1,2,3,4,5,6,7,8,9,10,11,15,16,17,18,19,20,21,22,23: /mod_base = "2'-O-methyl nucleoside"
  modified_base 24: /mod_base = "phosphorothioate linked nucleoside"
  modified_base 1: /mod_base = "5' end (NAG31) modification"
uaucagccccuuauuguuauacga

SEQ ID NO: 1183 - DNA, 22 bp, artificial sequence
  LPA RNAi agent sense strand
  modified_base 10,11,12: /mod_base = "2'-deoxy-2'-fluoro nucleoside"
  modified_base 1,2,3,4,5,6,7,8,9,13,14,15,16,17,18,19,20,21: /mod_base = "2'-O-methyl nucleoside"
  modified_base 1,2,22: /mod_base = "phosphorothioate linked nucleoside"
  modified_base 1: /mod_base = "5' end (NAG31)s modification"
gcagccccuuauuguuauacga

SEQ ID NO: 1184 - DNA, 22 bp, artificial sequence
  LPA RNAi agent sense strand
  modified_base 10,11,12: /mod_base = "2'-deoxy-2'-fluoro nucleoside"
  modified_base 1,2,3,4,5,6,7,8,9,13,14,15,16,17,18,19,20,21,22: /mod_base = "2'-O-methyl nucleoside"
  modified_base 1,2,22: /mod_base = "phosphorothioate linked nucleoside"
  modified_base 1: /mod_base = "5' end (NAG31)s modification"
gcagccccuuauuguuauacga

SEQ ID NO: 1185 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 7: /mod_base = "phosphorothioate linked nucleoside"
  modified_base 1: /mod_base = "5' end (NAG25) modification"
auaagaguuaucgaggcucauucuca

SEQ ID NO: 1186 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
auaagaguuaucgaggcucauucuca

SEQ ID NO: 1187 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 7: /mod_base = "phosphorothioate linked nucleoside"
  modified_base 1: /mod_base = "5' end (NAG25) modification"
auaggcagccccuuauuguuauacga

SEQ ID NO: 1188 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,13,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 1: /mod_base = "5' end (NAG25) modification"
auaggcagccccuuauuguuauacga

SEQ ID NO: 1189 - DNA, 21 bp, artificial sequence
  LPA RNAi agent sense strand
  modified_base 9,10,11: /mod_base = "2'-deoxy-2'-fluoro nucleoside"
  modified_base 1,2,3,4,5,6,7,8,12,13,14,15,16,17,18,19,20: /mod_base = "2'-O-methyl nucleoside"
  modified_base 1,2,21: /mod_base = "phosphorothioate linked nucleoside"
  modified_base 1: /mod_base = "5' end (NAG25)s modification"
cagccccuuauuguuauacga

SEQ ID NO: 1190 - DNA, 21 bp, artificial sequence
  LPA RNAi agent sense strand
  modified_base 9,10,11: /mod_base = "2'-deoxy-2'-fluoro nucleoside"
  modified_base 1,2,3,4,5,6,7,8,12,13,14,15,16,17,18,19,20: /mod_base = "2'-O-methyl nucleoside"
  modified_base 1,2,21: /mod_base = "phosphorothioate linked nucleoside"
  modified_base 1: /mod_base = "5' end (NAG31)s modification"
cagccccuuauuguuauacga

SEQ ID NO: 1191 - DNA, 21 bp, artificial sequence
  LPA RNAi agent sense strand
  modified_base 7,8,9: /mod_base = "2'-deoxy-2'-fluoro nucleoside"
  modified_base 1,2,3,4,5,6,10,11,12,13,14,15,16,17,18,19,20,21: /mod_base = "2'-O-methyl nucleoside"
  modified_base 1,2: /mod_base = "phosphorothioate linked nucleoside"
  modified_base 1: /mod_base = "5' end (NAG25) modification"
gccccuuauuguuauacgauu

SEQ ID NO: 1192 - DNA, 21 bp, artificial sequence
  LPA RNAi agent sense strand
  modified_base 7,8,9: /mod_base = "2'-deoxy-2'-fluoro nucleoside"
  modified_base 1,2,3,4,5,6,10,11,12,13,14,15,16,17,18,19,20,21: /mod_base = "2'-O-methyl nucleoside"
  modified_base 1,2: /mod_base = "phosphorothioate linked nucleoside"
  modified_base 1: /mod_base = "5' end (NAG31)s modification"
gccccuuauuguuauacgauu

SEQ ID NO: 1193 - DNA, 21 bp, artificial sequence
  LPA RNAi agent sense strand
  modified_base 1,7,8,9: /mod_base = "2'-deoxy-2'-fluoro nucleoside"
  modified_base 2,3,4,5,6,10,11,12,13,14,15,16,17,18,19,20,21: /mod_base = "2'-O-methyl nucleoside"
  modified_base 1,2: /mod_base = "phosphorothioate linked nucleoside"
  modified_base 1: /mod_base = "5' end (NAG25)s modification"
gccccuuauuguuauacgauu

SEQ ID NO: 1194 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,6,10,12,14,16,18,19,20,21: /mod_base = "2'-O-methyl nucleoside"
  modified_base 1,2: /mod_base = "phosphorothioate linked nucleoside"
  modified_base 1: /mod_base = "5' end (NAG31)s modification"
gccccuuauuguuauacgauu

SEQ ID NO: 1195 - DNA, 26 bp, artificial sequence
  LPA RNAi agent sense strand
  modified_base 14,15,16: /mod_base = "2'-deoxy-2'-fluoro nucleoside"
  modified_base 1,2,3,4,5,6,7,8,9,10,11,12,17,18,19,20,21,22,23,24,25: /mod_base = "2'-O-methyl nucleoside"
  modified_base 26: /mod_base = "inverted nucleoside"
  modified_base 6,7: /mod_base = "phosphorothioate linked nucleoside"
  modified_base 13: /mod_base = "NOTA nucleoside"
  modified_base 1: /mod_base = "5' end (NAG25) modification"
uauaucagcccctuauuguuauacga

SEQ ID NO: 1196 - DNA, 21 bp, artificial sequence
  LPA RNAi agent sense strand
  modified_base 1,3,5,7,8,9,11,13,15,17: /mod_base = "2'-deoxy-2'-fluoro nucleoside"
  modified_base 2,4,10,12,14,16,18,19,20,21: /mod_base = "2'-O-methyl nucleoside"
  modified_base 21: /mod_base = "phosphorothioate linked nucleoside"
  modified_base 6: /mod_base = "NOTA nucleoside"
gcccctuauuguuauacgauu

SEQ ID NO: 1197 - DNA, 26 bp, artificial sequence
  LPA RNAi agent sense strand
  modified_base 6,8,10,12,14,15,16,20: /mod_base = "2'-deoxy-2'-fluoro nucleoside"
  modified_base 1,3,5,7,9,11,13,17,18,19,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1198 - DNA, 26 bp, artificial sequence
  LPA RNAi agent sense strand
  modified_base 6,8,10,12,14,15,16,22: /mod_base = "2'-deoxy-2'-fluoro nucleoside"
  modified_base 1,3,5,7,9,11,13,17,18,19,20,21,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1199 - DNA, 26 bp, artificial sequence
  LPA RNAi agent sense strand
  modified_base 6,8,10,12,14,15,16,24: /mod_base = "2'-deoxy-2'-fluoro nucleoside"
  modified_base 1,3,5,7,9,11,13,17,18,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1200 - DNA, 26 bp, artificial sequence
  LPA RNAi agent sense strand
  modified_base 6,8,10,12,14,15,16,26: /mod_base = "2'-deoxy-2'-fluoro nucleoside"
  modified_base 1,3,5,7,9,11,13,17,18,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1201 - DNA, 26 bp, artificial sequence
  LPA RNAi agent sense strand
  modified_base 6,8,10,12,14,16,18,26: /mod_base = "2'-deoxy-2'-fluoro nucleoside"
  modified_base 1,3,5,7,9,11,13,15,17,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1202 - DNA, 26 bp, artificial sequence
  LPA RNAi agent sense strand
  modified_base 6,8,10,12,14,16,20,26: /mod_base = "2'-deoxy-2'-fluoro nucleoside"
  modified_base 1,3,5,7,9,11,13,15,17,18,19,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1203 - DNA, 26 bp, artificial sequence
  LPA RNAi agent sense strand
  modified_base 6,8,10,12,14,16,22,26: /mod_base = "2'-deoxy-2'-fluoro nucleoside"
  modified_base 1,3,5,7,9,11,13,15,17,18,19,20,21,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1204 - DNA, 26 bp, artificial sequence
  LPA RNAi agent sense strand
  modified_base 6,8,10,12,14,16,24,26: /mod_base = "2'-deoxy-2'-fluoro nucleoside"
  modified_base 1,3,5,7,9,11,13,15,17,18,19,20,21,22,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1205 - DNA, 26 bp, artificial sequence
  LPA RNAi agent sense strand
  modified_base 6,8,10,12,14,16,26: /mod_base = "2'-deoxy-2'-fluoro nucleoside"
  modified_base 1,3,5,7,9,11,13,15,17,18,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1206 - DNA, 26 bp, artificial sequence
  LPA RNAi agent sense strand
  modified_base 6,8,10,12,15,16,26: /mod_base = "2'-deoxy-2'-fluoro nucleoside"
  modified_base 1,3,5,7,9,11,13,14,17,18,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1207 - DNA, 26 bp, artificial sequence
  LPA RNAi agent sense strand
  modified_base 6,8,10,12,16,18,26: /mod_base = "2'-deoxy-2'-fluoro nucleoside"
  modified_base 1,3,5,7,9,11,13,14,15,17,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1208 - DNA, 26 bp, artificial sequence
  LPA RNAi agent sense strand
  modified_base 6,8,10,12,16,20,26: /mod_base = "2'-deoxy-2'-fluoro nucleoside"
  modified_base 1,3,5,7,9,11,13,14,15,17,18,19,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1209 - DNA, 26 bp, artificial sequence
  LPA RNAi agent sense strand
  modified_base 6,8,10,12,16,22,26: /mod_base = "2'-deoxy-2'-fluoro nucleoside"
  modified_base 1,3,5,7,9,11,13,14,15,17,18,19,20,21,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1210 - DNA, 26 bp, artificial sequence
  LPA RNAi agent sense strand
  modified_base 6,8,10,12,16,24,26: /mod_base = "2'-deoxy-2'-fluoro nucleoside"
  modified_base 1,3,5,7,9,11,13,14,15,17,18,19,20,21,22,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1211 - DNA, 26 bp, artificial sequence
  LPA RNAi agent sense strand
  modified_base 6,8,10,12,16,22,24,26: /mod_base = "2'-deoxy-2'-fluoro nucleoside"
  modified_base 1,3,5,7,9,11,13,14,15,17,18,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1212 - DNA, 26 bp, artificial sequence
  LPA RNAi agent sense strand
  modified_base 6,8,12,14,16,22,24,26: /mod_base = "2'-deoxy-2'-fluoro nucleoside"
  modified_base 1,3,5,7,9,10,11,13,15,17,18,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1213 - DNA, 26 bp, artificial sequence
  LPA RNAi agent sense strand
  modified_base 6,8,12,15,16,22,24,26: /mod_base = "2'-deoxy-2'-fluoro nucleoside"
  modified_base 1,3,5,7,9,10,11,13,14,17,18,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1214 - DNA, 26 bp, artificial sequence
  LPA RNAi agent sense strand
  modified_base 6,8,12,16,18,22,24,26: /mod_base = "2'-deoxy-2'-fluoro nucleoside"
  modified_base 1,3,5,7,9,10,11,13,14,15,17,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1215 - DNA, 26 bp, artificial sequence
  LPA RNAi agent sense strand
  modified_base 6,8,12,16,20,22,24,26: /mod_base = "2'-deoxy-2'-fluoro nucleoside"
  modified_base 1,3,5,7,9,10,11,13,14,15,17,18,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1216 - DNA, 26 bp, artificial sequence
  LPA RNAi agent sense strand
  modified_base 6,8,12,16,18,20,22,24,26: /mod_base = "2'-deoxy-2'-fluoro nucleoside"
  modified_base 1,3,5,7,9,10,11,13,14,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1217 - DNA, 26 bp, artificial sequence
  LPA RNAi agent sense strand
  modified_base 6,10,12,16,18,20,22,24,26: /mod_base = "2'-deoxy-2'-fluoro nucleoside"
  modified_base 1,3,5,7,8,9,11,13,14,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1218 - DNA, 26 bp, artificial sequence
  LPA RNAi agent sense strand
  modified_base 6,12,14,16,18,20,22,24,26: /mod_base = "2'-deoxy-2'-fluoro nucleoside"
  modified_base 1,3,5,7,8,9,10,11,13,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1219 - DNA, 26 bp, artificial sequence
  LPA RNAi agent sense strand
  modified_base 6,12,15,16,18,20,22,24,26: /mod_base = "2'-deoxy-2'-fluoro nucleoside"
  modified_base 1,3,5,7,8,9,10,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauauaguuaucgaggcucauucuca

SEQ ID NO: 1220 - DNA, 26 bp, artificial sequence
  LPA RNAi agent sense strand
  modified_base 8,10,14,15,16,20,22,24,26: /mod_base = "2'-deoxy-2'-fluoro nucleoside"
  modified_base 1,3,5,6,7,9,11,12,13,17,18,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1221 - DNA, 26 bp, artificial sequence
  LPA RNAi agent sense strand
  modified_base 6,8,10,12,14,15,16,18,20,22,24,26: /mod_base = "2'-deoxy-2'-fluoro nucleoside"
  modified_base 1,3,5,7,9,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1222 - DNA, 26 bp, artificial sequence
  LPA RNAi agent sense strand
  modified_base 6,8,10,12,14,15,16,18,20: /mod_base = "2'-deoxy-2'-fluoro nucleoside"
  modified_base 1,3,5,7,9,11,13,17,19,21,22,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1223 - DNA, 26 bp, artificial sequence
  LPA RNAi agent sense strand
  modified_base 6,8,10,12,14,15,16,18,24: /mod_base = "2'-deoxy-2'-fluoro nucleoside"
  modified_base 1,3,5,7,9,11,13,17,19,20,21,22,23,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1224 - DNA, 26 bp, artificial sequence
  LPA RNAi agent sense strand
  modified_base 6,8,10,12,14,15,16,18,26: /mod_base = "2'-deoxy-2'-fluoro nucleoside"
  modified_base 1,3,5,7,9,11,13,17,19,20,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1225 - DNA, 26 bp, artificial sequence
  LPA RNAi agent sense strand
  modified_base 6,8,10,12,14,15,16,18,22: /mod_base = "2'-deoxy-2'-fluoro nucleoside"
  modified_base 1,3,5,7,9,11,13,17,19,20,21,23,24,25,26: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1226 - DNA, 26 bp, artificial sequence
  LPA RNAi agent sense strand
  modified_base 6,8,10,12,14,16,18,20,26: /mod_base = "2'-deoxy-2'-fluoro nucleoside"
  modified_base 1,3,5,7,9,11,13,15,17,19,21,22,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1227 - DNA, 26 bp, artificial sequence
  LPA RNAi agent sense strand
  modified_base 6,8,10,12,14,16,18,24,26: /mod_base = "2'-deoxy-2'-fluoro nucleoside"
  modified_base 1,3,5,7,9,11,13,15,17,19,20,21,22,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1228 - DNA, 26 bp, artificial sequence
  LPA RNAi agent sense strand
  modified_base 6,8,10,12,14,16,18,22,26: /mod_base = "2'-deoxy-2'-fluoro nucleoside"
  modified_base 1,3,5,7,9,11,13,15,17,19,20,21,23,24,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1229 - DNA, 26 bp, artificial sequence
  LPA RNAi agent sense strand
  modified_base 6,8,10,12,15,16,18,24,26: /mod_base = "2'-deoxy-2'-fluoro nucleoside"
  modified_base 1,3,5,7,9,11,13,14,17,19,20,21,22,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1230 - DNA, 26 bp, artificial sequence
  LPA RNAi agent sense strand
  modified_base 6,8,10,12,16,18,22,24,26: /mod_base = "2'-deoxy-2'-fluoro nucleoside"
  modified_base 1,3,5,7,9,11,13,14,15,17,19,20,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1231 - DNA, 26 bp, artificial sequence
  LPA RNAi agent sense strand
  modified_base 6,8,10,12,16,18,20,24,26: /mod_base = "2'-deoxy-2'-fluoro nucleoside"
  modified_base 1,3,5,7,9,11,13,14,15,17,19,21,22,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1232 - DNA, 26 bp, artificial sequence
  LPA RNAi agent sense strand
  modified_base 6,8,12,15,16,18,20,22,24,26: /mod_base = "2'-deoxy-2'-fluoro nucleoside"
  modified_base 1,3,5,7,9,10,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1233 - DNA, 26 bp, artificial sequence
  LPA RNAi agent sense strand
  modified_base 6,8,12,14,16,18,20,22,24,26: /mod_base = "2'-deoxy-2'-fluoro nucleoside"
  modified_base 1,3,5,7,9,10,11,13,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1234 - DNA, 26 bp, artificial sequence
  LPA RNAi agent sense strand
  modified_base 6,8,10,12,16,18,20,22,24,26: /mod_base = "2'-deoxy-2'-fluoro nucleoside"
  modified_base 1,3,5,7,9,11,13,14,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1235 - DNA, 26 bp, artificial sequence
  LPA RNAi agent sense strand
  modified_base 6,8,12,16,18,20,22,24,26: /mod_base = "2'-deoxy-2'-fluoro nucleoside"
  modified_base 1,3,5,7,9,10,11,13,14,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1236 - DNA, 26 bp, artificial sequence
  LPA RNAi agent sense strand
  modified_base 6,10,12,16,18,20,22,24,26: /mod_base = "2'-deoxy-2'-fluoro nucleoside"
  modified_base 1,3,5,7,8,9,11,13,14,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1237 - DNA, 26 bp, artificial sequence
  LPA RNAi agent sense strand
  modified_base 6,12,15,16,18,20,22,24,26: /mod_base = "2'-deoxy-2'-fluoro nucleoside"
  modified_base 1,3,5,7,8,9,10,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1238 - DNA, 26 bp, artificial sequence
  LPA RNAi agent sense strand
  modified_base 6,12,14,16,18,20,22,24,26: /mod_base = "2'-deoxy-2'-fluoro nucleoside"
  modified_base 1,3,5,7,8,9,10,11,13,15,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1239 - DNA, 26 bp, artificial sequence
  LPA RNAi agent sense strand
  modified_base 6,12,14,15,16,18,20,22,24,26: /mod_base = "2'-deoxy-2'-fluoro nucleoside"
  modified_base 1,3,5,7,8,9,10,11,13,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1240 - DNA, 26 bp, artificial sequence
  LPA RNAi agent sense strand
  modified_base 6,10,12,15,16,18,20,22,24,26: /mod_base = "2'-deoxy-2'-fluoro nucleoside"
  modified_base 1,3,5,7,8,9,11,13,14,17,19,21,23,25: /mod_base = "2'-O-methyl nucleoside"
  modified_base 2,4: /mod_base = "2'-hydroxy nucleoside"
  modified_base 6,7: /mod_base = "phosphorothioate linked nucleoside"
uauaucagaaacagaaucagguguca

SEQ ID NO: 1241 - DNA, 21 bp, artificial sequence
  LPA RNAi agent sense strand
  modified_base 1,2,3,4,5,7,8,9,10,11,12,13,14,15,16,17,18,19,20,21: /mod_base = "2'-hydroxy nucleoside"
gcccctuauuguuauacgauu

SEQ ID NO: 1242 - DNA, 19 bp, artificial sequence
  LPA RNAi agent antisense strand
  modified_base 2-19: /mod_base = "2'-hydroxy nucleoside"
tcguauaacaauaaggggc

SEQ ID NO: 1243 - RNA, 19 nt, artificial sequence
  LPA RNAi agent sense strand
gccccuuauuguuauacga

SEQ ID NO: 1244 - RNA, 18 nt, artificial sequence
  LPA RNAi agent antisense strand
ucguauaacaauaagggg

SEQ ID NO: 1245 - RNA, 18 nt, artificial sequence
  LPA RNAi agent sense strand
ccccuuauuguuauacga

SEQ ID NO: 1246 - RNA, 17 nt, artificial sequence
  LPA RNAi agent antisense strand
ucguauaacaauaaggg

SEQ ID NO: 1247 - RNA, 17 nt, artificial sequence
  LPA RNAi agent sense strand
cccuuauuguuauacga

SEQ ID NO: 1248 - DNA, 19 bp, artificial sequence
  LPA RNAi agent antisense strand
  modified_base 2-19: /mod_base = "2'-hydroxy nucleoside"
tgagaaugagccucgauaa

SEQ ID NO: 1249 - RNA, 19 nt, artificial sequence
  LPA RNAi agent sense strand
uuaucgaggcucauucuca

SEQ ID NO: 1250 - RNA, 18 nt, artificial sequence
  LPA RNAi agent antisense strand
ugagaaugagccucgaua

SEQ ID NO: 1251 - RNA, 18 nt, artificial sequence
  LPA RNAi agent sense strand
uaucgaggcucauucuca

SEQ ID NO: 1252 - RNA, 17 nt, artificial sequence
  LPA RNAi agent antisense strand
ugagaaugagccucgau

SEQ ID NO: 1253 - RNA, 17 nt, artificial sequence
  LPA RNAi agent sense strand
aucgaggcucauucuca

SEQ ID NO: 1254 - RNA, 17 nt, artificial sequence
  LPA RNAi agent antisense strand
uguauaacaauaagggg

SEQ ID NO: 1255 - RNA, 17 nt, artificial sequence
  LPA RNAi agent sense strand
ccccuuauuguuauaca

SEQ ID NO: 1256 - DNA, 21 bp, artificial sequence
  LPA RNAi agent sense strand
  modified_base: 1,3,5,7,8,9,11,13,15,17; /mod_base = "2'-deoxy-2'-fluoro nucleoside"
  modified_base 2,4,6,9,10,12,14,16,18,19,21,21: /mod_base = "2'-O-methyl nucleoside"
  modified_base 21: /mod_base = "phosphorothioate linked nucleoside"
gccccuuauuguuauacgauu

SEQ ID NO: 1257 - DNA, 21 bp, artificial sequence
  LPA RNAi agent sense strand
  modified_base: 9,10,11; /mod_base = "2'-deoxy-2'-fluoro nucleoside"
  modified_base 1,2,3,4,5,6,7,8,12,13,14,15,16,17,18,19,20: /mod_base = "2'-O-methyl nucleoside"
  modified_base 1,2,21: /mod_base = "phosphorothioate linked nucleoside"
  modified_base 1: /mod_base = "5' end (NAG37) modification"
cagccccuuauuguuauacga

SEQ ID NO: 1258 - RNA, 19 nt, artificial sequence
  LPA RNAi agent sense strand
uuaucgaggcucauucuca

SEQ ID NO: 1259 - RNA, 19 nt, artificial sequence
  LPA RNAi agent sense strand
gccccuuauuguuauacga

SEQ ID NO: 1260 - RNA, 22 nt, artificial sequence
  LPA RNAi agent sense strand
acagccccuuauuguuauacga

SEQ ID NO: 1261 - RNA, 22 nt, artificial sequence
  LPA RNAi agent sense strand
aaagccccuuauuguuauacga

SEQ ID NO: 1262 - DNA, 21 bp, artificial sequence
  LPA RNAi agent antisense strand
  modified_base: 2,4,6,8,10,12,14,16,18; /mod_base = "2'-deoxy-2'-fluoro nucleoside"
  modified_base 1,3,5,7,9,11,13,15,17,19,20,21: /mod_base = "2'-O-methyl nucleoside"
  modified_base 2,3,4,21: /mod_base = "phosphorothioate linked nucleoside"
ugagaaugagccucgauaauu

SEQ ID NO: 1263 - DNA, 21 bp, artificial sequence
  LPA RNAi agent antisense strand
  modified_base: 2,4,6,8,9,10,12,14,16,18; /mod_base = "2'-deoxy-2'-fluoro nucleoside"
  modified_base 3,5,7,11,13,15,17,19,20,21: /mod_base = "2'-O-methyl nucleoside"
  modified_base 1: /mod_base = "2'-MOE nucleoside"
  modified_base 2,3,4,21: /mod_base = "phosphorothioate linked nucleoside"
  modified_base 1: /mod_base = "5' end cyclopropyl phosphonate modification"
tcguauaacaauaaggggcuu

SEQ ID NO: 1264 - DNA, 21 bp, artificial sequence
  LPA RNAi agent antisense strand
  modified_base: 2,4,6,8,10,12,14,16,18; /mod_base = "2'-deoxy-2'-fluoro nucleoside"
  modified_base 3,5,7,9,11,13,15,17,19,20,21: /mod_base = "2'-O-methyl nucleoside"
  modified_base 1: /mod_base = "2'-MOE nucleoside"
  modified_base 2,3,4,21: /mod_base = "phosphorothioate linked nucleoside"
  modified_base 1: /mod_base = "5' end cyclopropyl phosphonate modification"
tcguauaacaauaaggggcuu

SEQ ID NO: 1265 - DNA, 26 bp, artificial sequence
  LPA RNAi agent antisense strand
  modified_base: 2,9,12,14,18,22; /mod_base = "2'-deoxy-2'-fluoro nucleoside"
  modified_base 1,3,4,5,6,7,8,10,11,13,15,16,17,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 1266 - DNA, 26 bp, artificial sequence
  LPA RNAi agent antisense strand
  modified_base: 2,6,9,12,14,18,22; /mod_base = "2'-deoxy-2'-fluoro nucleoside"
  modified_base 1,3,4,5,7,8,10,11,13,15,16,17,19,20,21,23,24,26: /mod_base = "2'-O-methyl nucleoside"
  modified_base 25: /mod_base = "2'-hydroxy nucleoside"
  modified_base 2,3,23,24: /mod_base = "phosphorothioate linked nucleoside"
ucguauaacaauaaggggcugccuau

SEQ ID NO: 1267 - DNA, 21 bp, artificial sequence
  LPA RNAi agent antisense strand
  modified_base: 2,4,6,12,14,16,18,20; /mod_base = "2'-deoxy-2'-fluoro nucleoside"
  modified_base 1,3,5,7,8,9,10,11,13,15,17,19,21: /mod_base = "2'-O-methyl nucleoside"
  modified_base 2,3,20,21: /mod_base = "phosphorothioate linked nucleoside"
ucguauaacaauaaggggcuu

SEQ ID NO: 1268 - DNA, 21 bp, artificial sequence
  LPA RNAi agent antisense strand
  modified_base: 2,4,6,8,9,10,12,14,16,18; /mod_base = "2'-deoxy-2'-fluoro nucleoside"
  modified_base 1,3,5,7,11,13,15,17,19,20,21: /mod_base = "2'-O-methyl nucleoside"
  modified_base 2,3,4,21: /mod_base = "phosphorothioate linked nucleoside"
ucguauaacaauaaggggcuu

SEQ ID NO: 1269 - DNA, 26 bp, artificial sequence
  LPA RNAi agent sense strand
  modified_base: 14,15,16; /mod_base = "2'-deoxy-2'-fluoro nucleoside"
  modified_base 1-13,17-26: /mod_base = "2'-O-methyl nucleoside"
  modified_base 6,7: /mod_base = "phosphorothioate linked nucleoside"
  modified_base 1: /mod_base = "5' end (NAG25) modification"
uauauaguuaucgaggcucauucuca

SEQ ID NO: 1270 - DNA, 19 bp, artificial sequence
  LPA RNAi agent sense strand
  modified_base: 7,8,9; /mod_base = "2'-deoxy-2'-fluoro nucleoside"
  modified_base 1,2,3,4,5,6,10,11,12,13,14,15,16,17,18,19: /mod_base = "2'-O-methyl nucleoside"
uuaucgaggcucauucuca

SEQ ID NO: 1271 - DNA, 19 bp, artificial sequence
  LPA RNAi agent sense strand
  modified_base: 1,2,5,7,8,9,11,13,15,17; /mod_base = "2'-deoxy-2'-fluoro nucleoside"
  modified_base 2,4,6,10,12,14,16,18,19: /mod_base = "2'-O-methyl nucleoside"
gccccuuauuguuauacga

SEQ ID NO: 1272 - DNA, 21 bp, artificial sequence
  LPA RNAi agent sense strand
  modified_base: 7,8,9; /mod_base = "2'-deoxy-2'-fluoro nucleoside"
  modified_base 1,2,3,4,5,6,10,11,12,13,14,15,16,17,18,19,20,21: /mod_base = "2'-O-methyl nucleoside"
  modified_base 21: /mod_base = "phosphorothioate linked nucleoside"
gccccuuauuguuauacgauu

SEQ ID NO: 1273 - DNA, 26 bp, artificial sequence
  LPA RNAi agent sense strand
  modified_base: 14,15,16; /mod_base = "2'-deoxy-2'-fluoro nucleoside"
  modified_base 1-13,17-26: /mod_base = "2'-O-methyl nucleoside"
  modified_base 6,7: /mod_base = "phosphorothioate linked nucleoside"
  modified_base 1: /mod_base = "5' end (NAG25) modification"
uauaucagccccuuauuguuauacga

SEQ ID NO: 1274 - DNA, 19 bp, artificial sequence
  LPA RNAi agent sense strand
  modified_base: 7,8,9; /mod_base = "2'-deoxy-2'-fluoro nucleoside"
  modified_base 1,2,3,4,5,6,10,11,12,13,14,15,16,17,18,19: /mod_base = "2'-O-methyl nucleoside"
gccccuuauuguuauacga

SEQ ID NO: 1275 - DNA, 21 bp, artificial sequence
  LPA RNAi agent sense strand
  modified_base: 9,10,11; /mod_base = "2'-deoxy-2'-fluoro nucleoside"
  modified_base 1,2,3,4,5,6,7,8,12,13,14,15,16,17,18,19,20: /mod_base = "2'-O-methyl nucleoside"
  modified_base 1,2,21: /mod_base = "phosphorothioate linked nucleoside"
  modified_base 1: /mod_base = "5' end (NAG25)s modification"
aagccccuuauuguuauacga

SEQ ID NO: 1276 - DNA, 21 bp, artificial sequence
  LPA RNAi agent sense strand
  modified_base: 9,10,11; /mod_base = "2'-deoxy-2'-fluoro nucleoside"
  modified_base 1,2,3,4,5,6,7,8,12,13,14,15,16,17,18,19,20,21: /mod_base = "2'-O-methyl nucleoside"
  modified_base 1,2: /mod_base = "phosphorothioate linked nucleoside"
  modified_base 1: /mod_base = "5' end (NAG25)s modification"
cagccccuuauuguuauacga

SEQ ID NO: 1277 - DNA, 19 bp, artificial sequence
  LPA RNAi agent sense strand
  modified_base: 7,8,9; /mod_base = "2'-deoxy-2'-fluoro nucleoside"
  modified_base 1,2,3,4,5,6,10,11,12,13,14,15,16,17,18,19: /mod_base = "2'-O-methyl nucleoside"
  modified_base 1,2: /mod_base = "phosphorothioate linked nucleoside"
  modified_base 1: /mod_base = "5' end (NAG25)s modification"
gccccuuauuguuauacga

SEQ ID NO: 1278 - DNA, 19 bp, artificial sequence
  LPA RNAi agent sense strand
  modified_base: 7,8,9; /mod_base = "2'-deoxy-2'-fluoro nucleoside"
  modified_base 1,2,3,4,5,6,10,11,12,13,14,15,16,17,18: /mod_base = "2'-O-methyl nucleoside"
  modified_base 1,2,19: /mod_base = "phosphorothioate linked nucleoside"
  modified_base 1: /mod_base = "5' end (NAG25)s modification"
gccccuuauuguuauacga

SEQ ID NO: 1279 - DNA, 21 bp, artificial sequence
  LPA RNAi agent sense strand
  modified_base: 9,10,11; /mod_base = "2'-deoxy-2'-fluoro nucleoside"
  modified_base 1,2,3,4,5,6,7,8,12,13,14,15,16,17,18,19,20,21: /mod_base = "2'-O-methyl nucleoside"
  modified_base 1,2: /mod_base = "phosphorothioate linked nucleoside"
  modified_base 1: /mod_base = "5' end (NAG25)s modification"
aagccccuuauuguuauacga

SEQ ID NO: 1280 - RNA, 18 nt, artificial sequence
  LPA RNAi agent antisense strand
cguauaacaauaaggggc

SEQ ID NO: 1281 - RNA, 18 nt, artificial sequence
  LPA RNAi agent antisense strand
gagaaugagccucgauaa

SEQ ID NO: 1282 - RNA, 19 nt, artificial sequence
  LPA RNAi agent antisense strand
ucguauaacaauaaggggc

SEQ ID NO: 1283 - RNA, 19 nt, artificial sequence
  LPA RNAi agent antisense strand
ugagaaugagccucgauaa

SEQ ID NO: 1284 - RNA, 18 nt, artificial sequence
  LPA RNAi agent ense strand
gccccuuauuguuauacg

SEQ ID NO: 1285 - RNA, 18 nt, artificial sequence
  LPA RNAi agent ense strand
uuaucgaggcucauucuc

The invention claimed is:

1. An LPA RNA interference (RNAi) agent comprising a sense strand and an antisense strand, wherein the antisense strand comprises a core sequence that is complementary to an LPA mRNA sequence, said core sequence comprising the sequence of SEQ ID NO: 1280, and wherein the sense strand comprises a sequence that is complementary to the core sequence of the antisense strand.

2. The LPA RNAi agent of claim 1, wherein the sense strand and antisense strand are each 19 to 26 nucleotides in length.

3. The LPA RNAi agent of claim 2, wherein the sense strand and antisense strand are each 26 nucleotides in length.

4. The LPA RNAi agent of claim 2, wherein the sense strand and antisense strand are each 21 nucleotides in length.

5. The LPA RNAi agent of claim 1, wherein the LPA RNAi agent comprises at least one overhang.

6. The LPA RNAi agent of claim 5, wherein the LPA RNAi agent comprises an overhang at the 3' end of the antisense strand.

7. The LPA RNAi agent of claim 5, wherein the LPA RNAi agent comprises an overhang at the 3' end of the antisense strand and an overhang at the 3' end of the sense strand.

8. The LPA RNAi agent of claim 1, wherein the LPA RNAi agent comprises at least one blunt end.

9. The LPA RNAi agent of claim 8, wherein the LPA RNAi agent comprises one blunt end and one frayed end.

10. The LPA RNAi agent of claim 8, wherein the LPA RNAi agent comprises two blunt ends.

11. The LPA RNAi agent of claim 1, wherein the sense strand, the antisense strand, or both the sense and antisense strand comprise one or more modified nucleotides.

12. The LPA RNAi agent of claim 11, wherein the one or more modified nucleotides are independently selected from a 2'-modified nucleotide, a locked nucleotide, an abasic nucleotide, an inverted deoxynucleotide, a morpholino nucleotide, a 2',3'-seco nucleotide mimic, or a nucleotide containing a non-natural base.

13. The LPA RNAi agent of claim 12, wherein the 2'-modified nucleotide is a 2'-O-methyl nucleotide, a 2'-deoxy-2'-fluoro nucleotide, a 2'-deoxynucleotide, a 2'-methoxyethyl nucleotide, a 2'-amino nucleotide, or a 2'-alkyl nucleotide.

14. The LPA RNAi agent of claim 1, wherein the LPA RNAi agent comprises one or more phosphorothioate internucleoside linkages.

15. The LPA RNAi agent of claim 14, wherein both the sense and antisense strand independently comprise 1, 2, 3, or 4 phosphorothioate internucleoside linkages.

16. The LPA RNAi agent of claim 1, wherein the LPA RNAi agent further comprises a targeting group.

17. The LPA RNAi agent of claim 16, wherein the targeting group comprises an asialoglycoprotein receptor ligand.

18. The LPA RNAi agent of claim 17, wherein the asialoglycoprotein receptor ligand comprises galactose, galactosamine, N-acetyl-galactosamine, or a galactose derivative.

19. The LPA RNAi agent of claim 16, wherein the targeting group is (Chol-TEG), (TEG-Chol), (C11-PEG3-NAG3), (C6-PEG4-NAG3), (NAG3), (NAG4), (NAG3-AA2), (NAG3-Palm), (NAG13), (NAG18), (NAG24), (NAG25), (NAG25)s, (NAG26), (NAG27) (NAG28) (NAG29) (NAG30) (NAG30)s, (NAG31), (NAG13), (NAG31s), (NAG32), (NAG33), (NAG34), (NAG35), (NAG36), or (NAG37).

20. The LPA RNAi agent of claim 16, wherein the targeting group is conjugated to the 3' end of the sense strand.

21. The LPA RNAi agent of claim 16, wherein the targeting group is conjugated to the 5' end of the sense strand.

22. The LPA RNAi agent of claim 1, wherein the antisense strand comprises a sequence selected from SEQ ID NO: 6, SEQ ID NO: 111, SEQ ID NO: 156, SEQ ID NO: 161, SEQ ID NO: 162, SEQ ID NO: 164, SEQ ID NO: 169, SEQ ID NO: 170, SEQ ID NO: 171, SEQ ID NO: 172, SEQ ID NO: 178, SEQ ID NO: 180, SEQ ID NO: 181, SEQ ID NO: 182, SEQ ID NO: 186, SEQ ID NO: 187, SEQ ID NO: 188, SEQ ID NO: 189, SEQ ID NO: 1242, or SEQ ID NO: 1282.

23. The LPA RNAi agent of claim 1, wherein the sense strand comprises the sequence of SEQ ID NO: 1284.

24. The LPA RNAi agent of claim 23, wherein the sense strand comprises a sequence selected from SEQ ID NO: 195, SEQ ID NO: 270, SEQ ID NO: 310, SEQ ID NO: 354, SEQ ID NO: 355, SEQ ID NO: 357, SEQ ID NO: 358, SEQ ID NO: 359, SEQ ID NO: 364, SEQ ID NO: 365, SEQ ID NO: 366, SEQ ID NO: 371, SEQ ID NO: 372, SEQ ID NO: 373, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 383, SEQ ID NO: 384, SEQ ID NO: 1243, SEQ ID NO: 1259, SEQ ID NO: 1260, or SEQ ID NO: 1261.

25. The LPA RNAi agent of claim 1, wherein the antisense strand comprises the sequence of SEQ ID NO: 156 and the sense strand comprises the sequence of SEQ ID NO: 310.

26. The LPA RNAi agent of claim 1, wherein the antisense strand comprises the sequence of SEQ ID NO: 164 and the sense strand comprises the sequence of SEQ ID NO: 357.

27. The LPA RNAi agent of claim 1, wherein the antisense strand comprises the sequence of SEQ ID NO: 188 and the sense strand comprises the sequence of SEQ ID NO: 384.

28. The LPA RNAi agent of claim 1, wherein the antisense strand comprises the sequence of SEQ ID NO: 164 and the sense strand comprises the sequence of SEQ ID NO: 376.

29. The LPA RNAi agent of claim 1, wherein the antisense strand comprises the sequence of SEQ ID NO: 164 and the sense strand comprises the sequence of SEQ ID NO: 384.

30. The LPA RNAi agent of claim 1, wherein the antisense strand comprises the sequence of modified nucleotides according to SEQ ID NO: 790 and the sense strand comprises the sequence of modified nucleotides according to SEQ ID NO: 1189.

31. The LPA RNAi agent of claim 1, wherein the antisense strand comprises the sequence of modified nucleotides according to SEQ ID NO: 637 and the sense strand comprises the sequence of modified nucleotides according to SEQ ID NO: 1132.

32. The LPA RNAi agent of claim 1, wherein the antisense strand comprises the sequence of modified nucleotides according to SEQ ID NO: 709 and the sense strand comprises the sequence of modified nucleotides according to SEQ ID NO: 1135.

33. The LPA RNAi agent of claim 1, wherein the antisense strand comprises the sequence of modified nucleotides according to SEQ ID NO: 787 and the sense strand comprises the sequence of modified nucleotides according to SEQ ID NO: 1191.

34. The LPA RNAi agent of claim 1, wherein the antisense strand comprises the sequence of modified nucleotides according to SEQ ID NO: 788 and the sense strand comprises the sequence of modified nucleotides according to SEQ ID NO: 1189.

35. A pharmaceutical composition comprising the LPA RNAi agent of claim 1 and a pharmaceutically acceptable excipient.

36. A method for inhibiting LPA gene expression in a subject comprising administering to the subject the LPA RNAi agent of claim 1.

37. The method of claim 36, wherein the subject has or is at risk of having cardiovascular disease.

38. A method for treating cardiovascular disease in a subject in need thereof comprising administering to the subject an effective amount of the LPA RNAi agent of claim 1.

39. The method of claim 38, wherein the effective amount is sufficient to reduce the apo(a) expression level in the subject by at least about 40% relative to the subject's apo(a) expression level prior to administration of the LPA RNAi agent.

* * * * *

UNITED STATES PATENT AND TRADEMARK OFFICE
CERTIFICATE OF CORRECTION

PATENT NO. : 9,932,586 B2
APPLICATION NO. : 15/281309
DATED : April 3, 2018
INVENTOR(S) : Stacey Melquist et al.

It is certified that error appears in the above-identified patent and that said Letters Patent is hereby corrected as shown below:

In the Claims

In Column 164, Claim 19, Line 25, immediately after "(NAG27)" insert --,--.

In Column 164, Claim 19, Line 25, immediately after "(NAG28)" insert --,--.

In Column 164, Claim 19, Line 26, immediately after "(NAG29)" insert --,--.

In Column 164, Claim 19, Line 26, immediately after "(NAG30)" insert --,--.

Signed and Sealed this
Twenty-third Day of April, 2019

Andrei Iancu
*Director of the United States Patent and Trademark Office*